United States Patent 7,745,391 (HUMAN THROMBOSPONDIN POLYPEPTIDE) - sequence listing, part 72

SEQ ID NO: 257300 - DNA, 457 bp, Homo sapiens
tatacctgcaaacaacaacaatgacaaaaacataaaattctgacctcatgaagcttttatcctagtaatggaaatagacaataggccactctctcaacaccttctctgttgtctctgaagaatggaccttctactcttggtgctgtgtcccagggaagcaatggacatgaaatcctcctatgtaggctgagaacttatcccctagaaattatttccccagaaaagcaaatatacttttgacggagctctttaacactactatcattcagtaacattttcaatgaaaccatcttttgttaactctctggggtactgacaccatttaattcactgagaacagataataaacagaacatttaattcactgggagaaaataaacagaaagcctaattccacttggctgaatctgcctaagtccaacttttgcatataataaatgtttaaaataacgaacta

SEQ ID NO: 257301 - DNA, 451 bp, Homo sapiens
agcatatctttccttagttcagcctctgcatgagaacccagctttgcctgacaccttgattgcagccttgataagaccgccactctctcaacaccttctctgttgtctctgaagaatggaccttctactcttggtgctgtgtcccagggaagcaatggacatgaaatcctcctatgtaggctgagaacttatcccctagaaattatttccccagaaaagcaaatatacttttgacggagctctttaacactactatcattcagtaacattttcaatgaaaccatcttttgttaactctctggggtactgacaccatttaattcactgagaacagataataaacagaacatttaattcactgggagaaaataaacagaaagcctaattccacttggctgaatctgcctaagtccaacttttgcatataataaatgtttaaaataacgaacta

SEQ ID NO: 257302 - DNA, 494 bp, Homo sapiens
gaagggacccccccacaaaaaagtttataatgtattttcaggcagtcactgtacttttaaaaactgttgtatctgttaagctcatttggaaaaacgaactcatgatgtttgcttttaaaaatctgaatgaagcgtgtttcaacatatttgatagccatgcttttcttttatctacagaaatttcaatttatttaaaagcctggcgtttaatgcactacatgaccgcatgaattttagaggagccctcttgtatttctctgtaatcgtgtctaatgaaaacctgggattttccattattttttaaaaaagtgaaaatataatgcatcttcattaggaaaattgactgctgtgctcacgacagttcttaattgaaaaggcaacctattttaatggtgtggttgagaagaagattacatactttatccaaacacaaagacaattaataatgagaagcaggctgctgccattaactctaatgcagttgcatcaacgtc

SEQ ID NO: 257303 - DNA, 410 bp, Homo sapiens
  misc_feature (18)..(18): n is a, c, g, or t
  misc_feature (218)..(218): n is a, c, g, or t
  misc_feature (239)..(239): n is a, c, g, or t
  misc_feature (296)..(296): n is a, c, g, or t
  misc_feature (385)..(385): n is a, c, g, or t
gggagcgcctccgcgggngcccagccggtagcgagtggggggcaggcgcgcggcccaccctgcagcaagacgccggctccctcgtttccaggagctttgcagatagggggagggaaatccgcctcgattctccaggagaaaccccctctctcccccacttcgccaacactacccccgccaccaacaacaataaccgccgccgctgctcgtcctgctgncgccgccgccgccgcgcctgnccgccctgccgccgccgccgccgccgccgccgctgcccgggcaaaaccatggaaagngagacccccgcacctgtgcagctgagctcaagggcttacagaatactgggaagtctggtctgaaacgaaagcgccgagaccccccaagnaagagaactggcgaagcaaaggatt

SEQ ID NO: 257304 - DNA, 332 bp, Homo sapiens
taccgaatcagatgtttcattgtgacaagatccccaggtgattcatgtgcaggttaaagtttgagaagcaccaaagtaaaacatgaaactaaccatgtcttctcttatttaaaatgcatcaaagaccccccaccctaccccgcattgctttcatgatagagctcaagcttttgaaggtgatccacagtccacatgaccgggccgtgcctccttccctgccactctgtttatgggccccagaagcaccgctcataccaggccgctttttgcctccatgtcttcactcctctctcctctctcctctcttcctgaaactcctcttcctcactctt

SEQ ID NO: 257305 - DNA, 398 bp, Homo sapiens
gcttcaaagtcatttattttttcctgtattctctgcttccctgtagcatactctaaatggctttcccctcttatttctattcccaccagttcttttttcacactgttgtcagaccagctctccaaacatgtctttcttcatctgccgttctccagcagaaggcatccaattgacttccatatccagtaagaattctcttcccagcttatggagggccttgatttactttttgtatctaggcatttactttcctgaagttccctagcatacttcccctgctgcaagcatcataagtttattagccacatggtcatgcctcatctggtccccacctccatacatttgcactactttttctcttcactaggatattattccctgtatctttctattcatcc

SEQ ID NO: 257306 - DNA, 259 bp, Homo sapiens
ttcagccaccagtagccaaatcccttcccagttctttgctgctctcctggaacccacccaaaaaggcaaatggtattataactcagtactgtttatacatggatgggaggctgatctattcaggcagtgaggagaactacatagtcacagatcatgagtactttgagggcaggaactttatctttcatctttcatcctgaagacatggatcagcatatgtgtatagtaggagaacaataaatagttttcagaatgaagg

SEQ ID NO: 257307 - DNA, 491 bp, Homo sapiens
tacatgtgcatgctgtacatctaagccaagacacataaaaagaatcagtaggatgggtgcttagcttactcctctcactctctcttagttggttaagaaattaagttggtcctctgctcttagctggtcaagatttgtgtcaactggaaaaatgggaatctgcccactctgctgcaaaggtactgtgctttctaagatgggattttctttctgataacacagaacccacacatttcctctcccatccccagccttaggctagtctctcttacatctctctcctttctgatttgaaaggtattggcctctttttcttacctctctaaaattgttagcctgatcctagaatggatttagactttcacaggggatatagattcattgtttctgggtagattttgttttcagtcctgtagtacaaaccactcccaggacaaaagagcagagtttcttatttatcttcttaggaaggagggaaattacaggggaaa

SEQ ID NO: 257308 - DNA, 457 bp, Homo sapiens
acaacctttaaatcactgatatttgggggttgtttcagaaattagcaatagttggatacttccttaaaataaaagatacctattttagtctcaagcatcatgcataatggggaaatacaaagtattccatcaaagttagaagcaggggctgggtgtggtggctcatgcctgtaatcccagcactttgggaggccatggtgggtggatcacctgaggtcaggacttcgagaccagcctggccaacatggtgaaaccctgtctctactaaaaatgcaaaaattagccgagcatggtggcaggcgcctgtaatctcagctacttgggaggctgaggcaggagaattgcttgaacccaggaggcagaggttgcaatgagctgaaatcatgccactgcactccagcctgggtgagagtgagacaccatctcaaacaaaacaaaacaaaaacaaaaacaaaac

SEQ ID NO: 257309 - DNA, 706 bp, Homo sapiens
gggcgctcccactcctggagtacaggtcgtgcaaaaaagctcccgctacgtggagattgagcaagggcttggcaagcccaacggtgcgctcgaatcgcggtgcaagagcgtccccaccattctttacggccggaggtggaacagcagcagggcgagctgtctggagcccgaggcagccttagcttggtcagccaggcgctgtccagacctggcccaggctgctgccccacccaggcctcttgcccagcccacttcagtcggccttccaagactcggatcccgaaagctgtgccccctccagcaccaggcaaacaagctatatcttggtggagcagattccaccttcacagagccagagtgcaacagaatgccagaacagaagggtctccagagaccttacccgttatatagataacataacagaggctacgggttcaaggaagtgccttgtccacaggcaaccctgggaactcctgattattatctcaccactgttcccatccagcttcagtcctgagcccctgtgaccatccaccttgcctttctagaccaacaaagagagtgggtctttgccccagggactcagaccctcaagagccagagacccacgcctacggttccctaggatgcctacacctccagctggcctctgattccaccactccaggaagaagtgaggcacttggatatgcacacccaggttatg

SEQ ID NO: 257310 - DNA, 434 bp, Homo sapiens
tcaggatgtccttctgcctcatgcactgtggtcccacttacactggaaggaaggaggcagagggcactcaacggccaccactggaagctgtgagcagcatggcctcagcatctccatctgtaaaatgggttctggactagaggagagttcttgatatgacctaggagatagtgttccaaatgtatctgactctcgcaaggctaaatgcatggtagctcaaaataagactcatacaggatcggaagcaattaaagtgtaattttaacgaaagcaccaacaagcaaaagtgtgtcaagaaaaaatacagatgtatactaactctataatatagacaattatagtatatctggcccttgaccactttgcacctagtaaatctttcccctcccaccccatggcttagcacatttacacaaacacaccaaaaaaaaaaa

SEQ ID NO: 257311 - DNA, 339 bp, Homo sapiens
tctttttctcatctctttgcatagctgggtcatcctcatcctttaggtctcaactgaaaggtcaccttctcactgctactcccagctactcattctctttcccatgtttatctttgtcatagtccttcaaacaattggtaattaatttgcttattttaaaaaacttgtttgttagatgtgtttatcctgtttcctcctcccaactatgatctaagctctctgagaaggggcctcacttaccttcatgttcatcactgtagtgccacaatctagcaaattgcctggcatatggaggtgctcagcaaatacctgttaaataaatgaatgaatttttttgta

SEQ ID NO: 257312 - DNA, 261 bp, Homo sapiens
taaggcagatcctgtcaggctcattttaaagaagaaaacaatgttacacacagagagtaggtagctgtaccaacactgcacagataatattaggagggctcacagtctctttccaattggtgtaccatacagcaatgtgaatgagtgaaaaacaaactgcttctatgttttaattttttagcagtattacaatttgcaaagaccttgggtgaatatgatttgtaaaattaccgatttttgctgtgagaaatgcttgtctgt

SEQ ID NO: 257313 - DNA, 1226 bp, Homo sapiens
tcgtaagttaaagtcacaaggaaacaaggagagaagagagaagcaggtgcaggagaaggggctgaagacccatatagcgctagagagggatggatgacctctgttcccagtatggctgaatgcttaagagccagtctttcaagctgagcagatctgagtttgatttcccacctcttgtgctaactagctcagtgaccttgaacaagccacccaacttctctaagattgttctgttcatagacattaaagtatttatttctcggagttgttgtgagctttaaagagatgtgcgtgaataccaaagaagatattcacaacacaaaaccaccagagaactggtctccagacttttttaaaaaaacaaaagtctcttacaaatcagtaagaaaaaggcaggcagcccagtagataaacaggcaaaatacttgaacagacacttaacaaaagaggatagtaaaatggtcaaaaaaaatgaaaagatgatcaacatcattaataaagagaaaccagtgagatcatagcaacaatgtggacgaatcctatgaacacaacgttgagctaaagaagcaagatagagatgaatgcataaagtgattcaatgtatttaaagtttaaaagaaccaggcattaaaactccaattaaatattttatactctcatcagagaggcatatgtgaaaaatcggatgataccaactgtcggtgaggatacagtacaacaggaaatctgtatgctgctgatggaatgtaggttagtataaccattttggaaaacaccttggcattattgaataaaactaaaaacatgcatggtacacaacccagtaattttgttcttgggtgtatgtatataagaggaacttttcatatataccacgtatacatatacatatatgtgtatgtatgtgtatatacatatacacacatacaagcatgtccataattttattgctatcatggcctcagaaacagtgcaaatacccatcaactgtagaatgagtaagtagattgtgatatattcacataatggagtactatacggcactgagagggaattaactatgctatagagaacaatatgaatgaatcttataaacacgatgttgaacaaaagaaataatatgtattattttactttagaattcaaaaataagcaaaactaaactataaattatataatatagttatatattgatattatatagcatagactgttgaggaaactat

SEQ ID NO: 257314 - DNA, 511 bp, Homo sapiens
tccttcatgaagacatttccatttcattttgaggctgcaaaactcttaaagataaggaccacacttcctatcttaatctttgcatacagaaagagagattggaaaaatggaatcaacatcttaaggttcataatttcagggacttggcagaattagaccacagtaggttaacctaagttgaactaggatgattgcaaaatacaatgtttttataaaccatgtttaatctctcatctttacctctaaaaatgcagatgattttgatttttctaaagcccctttgtgtctgttttcctattattatttcactgtttattatcctgcatcaaaaaccttataaaacaacaaattgagttttaatttgaaaagttttgttatttcatatttcctttccattttctctgatcaagtttcaaaatgaaagcaaccaaagtgagagaaaggaaaaggaaaagactgaaaacaaatggctgctaatgcagctacatggaggagacgggcaataggagaa

SEQ ID NO: 257315 - DNA, 501 bp, Homo sapiens
gcagtccaactccatagtctgagctcttctacttgaaaacgcagtaaatggtataatggtggagttcctactgttactatgtaaaggatcaaagccacaggaccatgtaactgggcgaggtacaggaaaggtctgatccattctgagagaggtaatttccttgagtttgattttagctgaattctcaaagaagtgcaagagtcagaggaaaggctgggcaagagagttttagactgaaagaatgatacatgtagtggttctgaggcaggaaagagcaaattgagtccagagaatttaaaatggtatggctggattgtagaatagggagtaatgagtggcaggtgatgaacctgaagaattgtatttcttttttatttccacatcacaatttttggcataaagagtccgttttgagaaatcctaattaaagtaaaattgcactatgcagaaacttcagttgctcagagttttgggctatactcatttcaggaaaaaaaaaaa

SEQ ID NO: 257316 - DNA, 423 bp, Homo sapiens
  misc_feature (17)..(18): n is a, c, g, or t
  misc_feature (93)..(94): n is a, c, g, or t
  misc_feature (130)..(132): n is a, c, g, or t
  misc_feature (138)..(138): n is a, c, g, or t
  misc_feature (160)..(161): n is a, c, g, or t
  misc_feature (175)..(175): n is a, c, g, or t
  misc_feature (178)..(178): n is a, c, g, or t
  misc_feature (193)..(193): n is a, c, g, or t
ccccccgcccccccccnncccccccccccccaccctccctgccctgcgccgtccctcctcacacatactaccgcaccccctccctctcccctnntgggggggccgcccccccctgtatagggtgggggtnnnaaaaanaaaaaaaaagggggggaagggnnggcccgcaaaaaanaanttttgggcgaagggntttcccccccgaagagaagcaatttaaaatggtatggctggattgtagaatagggagtaatgagtggcaggtgatgaacctgaagaattgtatttcttttttatttccacatcacaatttttggcataaagagtccgttttgagaaatcctaattaaagtaaaattgcactatgcagaaacttcagttgctcagagttttgggctatactcatttcaggaaaaaaaaaaa

SEQ ID NO: 257317 - DNA, 420 bp, Homo sapiens
acagaatcacacataattagtagctaactatatatatcgttctttgagagtctaaagaatatcattcactctagagcttgtaaatatttcattcaattgatttgcttgatcagaccacaccaattaaaagcaaactgcatatgtctcccaaactcagttcaggggaaggggctcctctagttgcctcctgtgaggtttcctaatttaagtcagtccctgttttactacacatggtgaagtcgtgttatctctttggactataccatcatctaaactcacacaaaagcacgaggggctgtaatccctcattccacaaaaccccaagttaaccaaagttgtcacacatagatctggaaagatggcaaactctttaaagataatagcaactgtctaaaaggataacaaaacattgttttgagc

SEQ ID NO: 257318 - DNA, 6037 bp, Homo sapiens
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttgggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 257319 - DNA, 6070 bp, Homo sapiens
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 257320 - DNA, 5860 bp, Homo sapiens
ctccaaagctgggggaagagaggggggttgtgtgcagatggcccttcaatctcgaaagaaagatgtcggaatctgaaggcgggaaaggtgagagaatccttccatccctgcagacccttggagcaaggcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 257321 - DNA, 6138 bp, Homo sapiens
ctccaaagctgggggaagagaggggggttgtgtgcagatggcccttcaatctcgaaagaaagatgtcggaatctgaaggcgggaaaggtgagagaatccttccatccctgcagacccttggagcaaggcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggcgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccatggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagtatgccctctatacccttacctagaatccaggggacaatgtattgccctacacagtcccctagcccccaaacctccgactgctgcatctcattacccagtcaatagatgccccaaagtttccactgccccatcctctgccctctctgactgccctccagttcttccctggcaagctctggggtattggtaggaggaggtagtgatgagctggtggggccttgagaaagggctagtgggggcatcgccaatccagtggtacctccccaactcctccaggggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 257322 - DNA, 618 bp, Homo sapiens
gacattaataccgggtaaagatttaagaataacatactaaatataacaaacaacatcacaaaattataagggggtcaattcatccagagcgcattctcccaaaggtgcatatacctgcaaagagaccttcaaaaccacgaagcaaagctgagagaactaaagggagacaaggtaagtcaccatcacggatggagatttccacagaactattcaataagtaaccaacaggtacataaaaatcagtaaagacacggaagattcaaacaacactattatccaagttgacctaatgggcatttattgagcagtccaacaacaacggaatacacattatttacaagtgtacacaaaaccttcaccaagacagactcttctctggacaataaagcaaacctcaatacatttaaaagaaccaaaatcaaagaatggtttctgacaaaggaactgaataaaacttcagcaatacaataatatctgaaaaaatccaaactattttcaaataaataacacttttatattacacgcagtatcaaagaaaaaacacacaaaagtaaagcaaatttaatcccaaagtaagcagcaagaaaaaaacaataaagatgtgaaatcaatgaaata

SEQ ID NO: 257323 - DNA, 640 bp, Homo sapiens
gctgactactatagtattctatcaacagaagcaagattgaggtagagtttacagaggttcacagtgaccatgcttctaggtgtcatgagatggaaggaacctcaagcagtttctgttctaggatttggtcattttcctgccatgctcatgttccattaccctcgtagtatgcctggtctgaaaaattcaatctgccttaaccatttgaatctctaaacaaaccttgcaaattaatacaagtctcaaggaccaggctgaagagaacgagacgggacctggagaatataaaaaagcgggtatcagctgggcgccatagctcatgcctgtattctcaacattttgggaggccaaggcaagaggatcgcttgaggccagtaattgggaagaccagcctgggaaaaataatgagaccctgtcttaacaagaaatttaaaaattagccgggcgtcatggcaggcacctgtagttccagctactcaggaggctaaagcaggagggtaagtttagcccaggagtttgaggctgccgtgagctatgattgggcaactgtagtctagcctggatgacagagtgagaccttatctctttccagtcttgataaacaaggttccaaattgagttaattttgcccctagcaaat

SEQ ID NO: 257324 - DNA, 501 bp, Homo sapiens
ttcttccctctccagctaatgactatatatcagatggataatgaaaaagtcctgacgttcaggagatggctgagaagacacatatccaccagacagaagtattttgaagtatataatttttccagatcgtggggaatctgggatatatttaattaactatttctgaactgttatctaagtgttttatttatttctatgtagaaaatgaactaaaatgggggcacgctatgttttataagaaagttaaaaattttgttttaactcagatactagacaaacttggaaaatcatctaagaagtgagaaagtaaaaataaccattggggataattacaataaagagtactaaatttatagtggtattttcttcattgcatttagatctataatctctctggagaacaagtttctattacagaggaattgagttcatctgtatacattaaataagcccatctttcaaataacacttcccaaacactgtatcattttaccactgatt

SEQ ID NO: 257325 - DNA, 128 bp, Homo sapiens
cccaaagtgctagaattacaggcatgagccactgcatctggccaggagttaaaaaaaaaaaaaggtaactttcagtcaaatcacactaaaacaaacgtcctaggaccagccaaagttctttatatttc

SEQ ID NO: 257326 - DNA, 672 bp, Homo sapiens
gtatgggagacctattcgtgggccagggaaagagcttatttgacctgtgaagggaagatccccctctaaatttaagcacatacccatgaccatgtaaggctaaataacccttcccctgttacttttgggagagaatgaagacactgaggatgacttcatttcccttattttcttctgctaacaacagttttgagataagcagtactatagagcagggatctgcaaacggggccaaatcccattcatacctgttttgtttgtttgtttttgtgtttgtttgtttgtttgagacaatgccccaccctgtcaatcaggctggagtgcagtggtacaatcatggctcactacaacctcgacctcctgggttcaagtaattctcccacctcagcctcctgagtagctgggactacagtttcacacaaccacatctggctaatttttgcttttttgttttgttttgttttgctttgtttatttttgtttctttatttattttttttttgtaatgacagcatttcaccatgttgctcaggctggtttcaaactcctgagttcaagccatccacctgcctcagcctcctgagtagctggaactacaggcatgagccactgcgccggaccgcatacctgtttttgtaaatagagctttattggaacacagccatgcccatt

SEQ ID NO: 257327 - DNA, 678 bp, Homo sapiens
gcagccaaagaggtaggaaaaaaacaggaaagggagttaaagaggccaaagtaaaaaaataaaatggctttaggaatgagggaatgataaacaatgtcaaggattgcaaagtaagataaatgaaatgcaaaatataccttggatttttggataaggaagccgtcggtaaccctggaaggtggttgttttgttttgttttgcctgcttgctttatgatgatgatgatgatgattattattatactttaagttctagggtacatgtgcacaatgtgcaggtttgttacatatgtatacacgttccatgttggtgtgctgcacccgttaacttgtcatttacattaggtatatctcctaatgctatccctccccctttcccccaccccacgacaggccccagtgtgtgatgttcccccccgcctgtgtccaagtgttctcattgttcaattcccacctatgagtgagaacatgtggtgtttggttttctgtctttgtgatagtttgctcagaatgatggtttctagcttcatccatgtccctacaaaggacatgaactcatccttttttatgacctgcatagtattcaatggtgtatatgtgccacattttcttaatccagtctatcattgatggacatttgggttggttccaagtctttgctattgtgaatagtgccaca

SEQ ID NO: 257328 - DNA, 422 bp, Homo sapiens
agtggaaatagtctagtcaccagtccctaagtgctgatttgtggaccagttgctgcaggtctcaattcccaggaggtcccgtcgctggagattctgatcaagtagattgcacagcactcaggaatcagtcattgtataaggaaatccccaggagactctgatgcatgactacctttgggaataggctctctgggttttacaaagccattttgtgtaaaactataatttgaactcattttcgttggatgtggaatgcagtttggggattgataagggcttagttcacattggaagaaaatcagaattatagagtaattataaagagatgtaattaaaatacaaataccaatctcactaatgtaaactaaggttaatgttgccaaatacgactgttttaatgaataaattagcacgtgaattat

SEQ ID NO: 257329 - DNA, 235 bp, Homo sapiens
gcatagcctgttcagaggaccttacaaaattgtgcatcatgaaatttatcaactacttatagtaaaggaatgacaaaaataaatttaaaaggaggggttagcttccaccacctagactactatcatatgcttttatattcctatatgcacagcatatgcttctatatatgttagacatcttaatatacctgggttagcggcagcgtaagatggttttaagaagaaaggctctgca

SEQ ID NO: 257330 - DNA, 412 bp, Homo sapiens
gggagtgggtgctgattggtttgtgagtatgggaagaaaggctaaagcaaaggcactactcaaaagtgagcatggcagtgtataaaaccaattaggaaagggtaggtatatgtattataaaataagtgaagtatagagatcactcagaggaaagcacaccaaacaggaagacaggttctcaatctggtttacccaggactatctttggcttgaaggtcaggtttcaccagagtcctgcccctatgtgcctaggcatttgactgcctcttgtcactatcattaattcatagaagtaactgtactaagtaaaaatatatgcatgaatagcacccagaaaaagtctgaaagggtgtaccgggactatttttgtttcaaatttggagaaaaccaactgaagtcaacttaagcaaaa

SEQ ID NO: 257331 - DNA, 294 bp, Homo sapiens
tggaggagggggtgcagggggcttagcagccttccagggaaccagcgctattcttccatccagtttggacttccagagcagcgggagcacacgccaggccccatcttagtcgatttctgctgctttgttcaggggactttgtaggtacctggagaaacataaagaggaccccgggcctagaagcagcgtggcacagagaatggctccaacaccgagtgggctgcgccgggctgctctctttctgtagcccttagagtgatcccgaggctggtggggaggttcgtggtgcagggg

SEQ ID NO: 257332 - DNA, 346 bp, Homo sapiens
ttcatataaatggaaccagacagtatgtacttttatgtctgactttttttgctcagcatgaaaaactatattcttccattaaaggttgaataacttaaacaaaaaaaaaatttttttttttttttaatggactcaagcgatcctccttcagccttcccagtagctgggactacaggcacatgccacggcacctggcagctaggctgaataacataaaagattggtttttctgatattaatatcaagttcaaaattttaaaatttcacatgaaaattcaactaggaatatttttggaattttacaaattgttttttatcagaataaataagaatgattgagaaactt

SEQ ID NO: 257333 - DNA, 512 bp, Homo sapiens
gtgagttcttactcttgcaagactggattagttcttgcagagatggattagttccctcaagagtaggttggtataaaacatgtcaccctccttggtcccttccttttcacacatgcctaccccagttttgaccttctgttatgttatgacacagcaggaaagccctggccagaagccagcgccatgcccttgaaatttcccacctgcagaaccatgagctcaatagacctcatttctttctaaacgacccagtctcagatactctgttatagcaacactaaattgactaagacagtgttattttgtagaagtaatgtaatccctctgaaaagaacatgggattcagagaaaaatgccacagctcttagtccagttttgccatgacctagtagaatgagattgctgatgctaaaaatgttgaaataaaatcatagtataaaggtcctaaaaccacacctggcacgaagtaggccctgcacgaatgtttgctttagctatgtgttttctcacaa

SEQ ID NO: 257334 - DNA, 323 bp, Homo sapiens
gattctctagtagccctaattctacccatctggctactaattcaaactttcttccttcacatctgtttgtggacttctccaatataactagtatgcctgggctcattctgcttcttctcttctggaatagtttatttcatgaccatgtgcagagggggtgatggggcaagcctcacaagccccggaggtctgtggctgaggtgtaccttggctttgttgcctggaactgctctgactctgctcttcgctctttcctgggctgtgtcactacagctctgactcctttccaccttggagtttagcttcctaaaaaagaataaata

SEQ ID NO: 257335 - DNA, 254 bp, Homo sapiens
cccagctcagaccagcagatggaggaggggattctgagcactctgcggaccctctaggacctactcacccccattctatggacattttcccataaactgtgaaggaatggagggaaagagaactggaactgggaccatctgcaaacttccccctttttcgaccctcgcacctatcaccccatccccataccagacacaggtggcccttacctgggtcccgcagagaagggaataaaagccagaggtgacctctc

SEQ ID NO: 257336 - DNA, 601 bp, Homo sapiens
ggctgatgcttgtaatttaatgtggatactaatccattaagcttgtttattcatttccttaatttacatgtggccactagctagacagactttaggagttgctatggtaacttttcccttttttgctaaccatttggaaaccttacatttttcaaatctgcatgctttgaaaaggcctgcttgattctactttgtttttcaagctttgctttgatttactgtatttaatttgcttcaccttctaatttgttaaatgacatgttattaaaattccccagggggccagcaggaatctgtgccgctgagagacagcatgcattctggaagtcggtgattcacatctgagcactcagaggagattttggaaacccattaggttagcagagccgctctgggcagaatcagcgctggcagggacgctgcatttgacaactcaagtctttaggtgatgctgaaaagcctgccctagcttctcatttcctccgtcccccagcgaatcgttctttgctgctgctgtcctcggtgtgaaaaggtgacccccccactgcccatcgcacctgcttgctatctctcgtcggtcaccccctacaagaccggaaaa

SEQ ID NO: 257337 - DNA, 381 bp, Homo sapiens
tggatgggagactgcctgggaatacaaggtgctgcaggctttaaacaaacaaacaacccattccagataacttttggaaaaccgtttcacggatcattacacagaagcaaatgtcaataaaacatgtgatatattgcttcttaatattgtattattgctttgcgaaatatcaacatgatatgaaaataaatatgaacaggattgttcatgcacctaaaaaacaggcaaacaagatagagtcttatctgaagagaaaatattggcttggcacagtggctcatgcctgtaatcccagcacttcaggaggctgaggtgggtggattgtttgagcccaggagatccagaccagcctagacaacatggcaaaaccctgtctctaca

SEQ ID NO: 257338 - DNA, 420 bp, Homo sapiens
ctggcgaatggtttagagttctttcaagacgccaccattacaaggtagttatcttaactccttgtttaatcctgactccagtgtttactagagttgtgactaaatgacatgagcatcactcttttcacctttgaaaataaatacgtctgctccacctttcacgtgtaaagttgttaagaaaaattcaagtattttaccattattctgaacagagaaatttctcatttttctaccagaagaatgttgctgtaagcatcaaataaacactagtttcctttgtatagtgtcctggagataaagctatcagggcttttatacggctgagcaggatcatggaaagaattcagcatcacatcctcaccacagaaaacaccctactcctgattccctaaagcttacatgaaggaagcccttgtggtg

SEQ ID NO: 257339 - DNA, 996 bp, Homo sapiens
cagccctgggtaactggccaccacgccccgggcctgtctatcctcttcttttcccagaggttccccagccttcctagtccaccaggaggcggccaagagcctcttcctatcatgacacaaccacttccccttccaggtgcttggtgctgatggcaactgctgccacctgctctgctcatgccaggctggcagagggcacagatccttgagagagtgcaaggcccgccaggctccagggtctgtgcctgggcagactctattcatggggctccatgcccctcctttccctgactcaggcagagtagccatggccccttccactttgggtggagcaggttgctacctggcaaacccctggggtgctgcatgtcacccagtccctgcaggtcctgcaaattaatattctggagtcgcctgtgcttcctgtttgcatgggaacgaggctgcatggcagagccctctgcctgccctgccacctgcataccaatagggctgtggttcccgctgcagctccgggcctaacatctctgctgctgcagtggcagtgacaggctggtgggagattccccttgcctgagcccatgtgctctctgcagggctcctgcaagggaagccagtactgctggcgacagttccagccctaggcagggttatctgctgggagccaggagtgcttggacctctgcccttccctgggcaggcaggctggaatctggctcctacaaccctggcattgccgggagcagcaggttgacggctgtccattgcttggctgagtgatcagagtgccacgggccaagccaagcttgactaagaacagataaccctccggccagctcagggccttgctgagcacttcacgggctggggagacctgagctggctgccatttccttgccaccatcgtgggctgtggctagttacctccaggaaggccttctgcagtttccaaggaccctttctcctggtgctgggggcaggacatgggttgggaat

SEQ ID NO: 257340 - DNA, 569 bp, Homo sapiens
acccacggctctcgctcttttctgggaccttggcctctcgcactctcctgtctgttgatctttccaccatgctgccattccctacctctcggaaatagactttttttggatgtctttttgttttccttctgtgtgacctatttgtaggatccctttactagactgactttccaggagtgttcctcagcccccgcacagatcagtagggaggagcctgcctgctgcttgctcatgctaaaccagcgtgctgcccagcctgtgaagtttggaactggaacactagagttggccccaaattacagctttctcttctggctcctgggactcccagtttcttcagcaacaacaacaaaacctggaaaaacgtatccttgccagaggtgggagaatgaggctcacaaaaggaaaacacggacctttcttgtctcccccagtgagaggttgcaagatcaggttgtaaaaccccattaaggaggaccttagaggaagaactgagcaaggagccttctcaggtgcctgcaaacatctccaagagcaaaagtataaatcctcatattgtggaggaggta

SEQ ID NO: 257341 - DNA, 394 bp, Homo sapiens
gatatatatataaggtagttagaacagtgtctggcacataataagttgtatgtaaatgttatctatgattattaccaacatcaattgttatttctcatgaggaatattaagaacttcactattaattggctatttaaaaatgtaataggttggccaggcacggtggctcacgcctgtaatctcagcactttgggacgccaaggctgatggatcacttgaagtcaggagttcaagaccagcctggccaatatggtgaaactcccatctctactaaaaatacaaaaattagtcgggtgttgtagagggcccctgtaatcccagctactcgggaggttgaggcaagagaattgcttgaacctgggaggcagaggttgcagtgatccaagatcgcacc

SEQ ID NO: 257342 - DNA, 123 bp, Homo sapiens
aattatgtagtttttacaaatgcctttgctattgacccaggagtgcatgtaattataaactgactcatcaaagtgttctaattccaaggctagaatccattaacttataagactctccaataa

SEQ ID NO: 257343 - DNA, 391 bp, Homo sapiens
caatatctaagagcatatcaaatggatcatacaccataatcaagtggttttcataccaggatgcagggatggtttaacatctgcaagtcaataaatgtgatacaggttgggtgtggaggctcacgcctgtaatcccagcactttgagaggctgagagggtggatcatgaggtcaggagttcaagatcagcctggccaacatggcaaaaccctgtcactacaaaaaacatatacaaaaaaattagccgggcattgtggtgcacatctgtagtcccagctactccagaggctgaggcaggagaatagcttgaacctgggaggcagaggttgcagtgagccaagatcatgccactgcactccagcctgggtgacagagtgagactccatcttag

SEQ ID NO: 257344 - DNA, 393 bp, Homo sapiens
cactgagacggaatgaatacatttttcatgtgagaaggacttgaattttggggaaccagaggtggaatgctatggtctgaatacattttcctaaaatatgtatgtttgaacctaatctgcagtgtgacagtatgaagacataaggcctttcagaagtgatttgagtcatgaggatggagctcttacagaattagtgcactcagaaaagattcttgaagtagccctcagcttcttccaccatgtgagagcactgagaaggtgccacctatgaggaacaggttcacagacataagatctccccatgctttcatcatggactttgcagtctccagaaccaggagaaataaatttctattgtttatgttaaaacaaactaaataaagcccgagaagc

SEQ ID NO: 257345 - DNA, 412 bp, Homo sapiens
atcatcctcattatttttatggatacctaattctccatcatgtggaggtaccacagtttattgaaccattcctctactggcgaacatttgagctgtttccttttttttttctagtacaaatatgcctcatgaataactttgtgcatgtatcatgttgcattggtacagttatatctttagaattctagaagtgggatttctggccaaataataaacacagctgtgatcttgatagatattgacatactctcctccaagggagtggtatcattttgcattcctaacaacaatatatggtggtacttgtttatctgcggccttaccaatagaatatattgttaaaattttgatttttgcctgtttggtggggaggtagcatggtgtagtcttgatgctcgtctctctatgactg

SEQ ID NO: 257346 - DNA, 425 bp, Homo sapiens
acagcttttcagcaccatgtatgttaaataggctcttgtgaactggcctaggaacctaattactgttatagtacagtttctgtgggaaaatgagatctagatgcaataagctttgggaaatatacccaatatgtaagttagggattatctgatcagttatctaaaaaagtcaggatcttcattctctggagtgtggctgtgttagggaagtgagaaagggtgaattgggagattaactctgaagaaaaggaaataaagatgtcaaaggcaaactttgcttgttctgtgttttatccaagtctctcatggtgtaattaccattgacttcttaaaatgatctcagattctcctttaggttactgttgtaagttaccatcatctggcatatttcatattaataaatattttcatttttaatgatgtta

SEQ ID NO: 257347 - DNA, 873 bp, Homo sapiens
tgtcatccatgaacacccagatagaattgttgctgttttgcagaatcatcaacacaggctcctggggcgtcaaaggtgtcacagcaccctgactgcaagagtagattgggagatgctgttgtgtctcgaaatcatccttggcgaatctccatcacacttggccattttatcttcctgttcactttcagtgcccaaggaagagaattgtgggaccaatagcaaaaccttccccacttgccttccagccatggtgagaatttggaggaaatgaaaaatagcctaattctcatacaccaaaaaatatcaagagttcctgttctaatgagttgtttttacattccacttgacaggaggctgacgatttgtggtttgcagtgtgagtgaccttcttgaaaagcattctgtatcttcattgactttgaacagaccttaactgctgggtgaatttgggcacagttcattccctcggcagatgggcgtgccagatatcacgtgtactgtcttgggcctgtaatccaaatgcacagtagatattaccaccctccgactttgttttgggaaatccccggatgtagaaacattggagttgtcaatttcatgtgcgtgggtctttccctaaactgtgaatccttcctccccaaaatatcattcattaattgatcttaaaaatcagctgggagttaggctccttatttaacactgccatttgcacctctcgcttatataacacatttgatattctctttatctgctttgtccccacctttgaatatctcatggaggctgagctttgccaaacagacagataggaagcaaaattagaagcttttttctgtgctgacttctaagggccttcctggttttctgtgaagc

SEQ ID NO: 257348 - DNA, 433 bp, Homo sapiens
gaaacaagttacccagcgatactgctggcttagtaaccaggtacctaataaattcttccatggcgaccatatgaccttattctttaggtttagacacaagggatttccttggtttggtgacagaaaggtaagagttatattaccatcaaggtcaccatttgacttttaagaaaaacccattcccgccgagcatggtcactcatgcctgtaatcccagaacttttgggaggctgaggcaggaggattgcttgagctcaggagctcaaaaccagcctgggcaatatagcaagacctcatctctactaaaattccaaaaacctagctggggttggtagcgtgtatttgtagtctcagctacttgggagggtgaggtgagaggatcacttgggcccacaaggtcgaggctgcagtgagccctgattgtgccactata

SEQ ID NO: 257349 - DNA, 453 bp, Homo sapiens
ctctctctctttctctctccatctataaagcccaaaacatttttggtcccgagcattttgtataaagggtactcaaactgtagaaggcaaacatgaaaaggctaattcagcttctctaaccttcaagttctaattctaaatgaatgtctcattctacgacagtacactaagtttatactgtatgattgctttttttcacccactccaatggttcaaagttatttctaatatgaaaatactttagttttctcaaaacttttctctgcaaaactaaattccagctgtcagcccttgagtgtataacaagtggtaaagaaagactaaatgtaaatgttagcaaaattgatggttgctgtcacagagccatagcttgatctatagagtgcctacagcttgtgaggtaagcaacacatttgaaacttataaatatgaagtttctcttctgatgttaaa

SEQ ID NO: 257350 - DNA, 421 bp, Homo sapiens
ccttcagcaacatacaaaaaaagaatgtatcttcttttaaattttgtctcttaatgaagatggaataaagtatatactactctctgagctattggagagtatcacatggtgacttttataaagaaatatacaattaaatttcaggattaagcaaacattttttcctggccttttagaaaaaataatctttactgtccatatccttggacttgtcagatatactcaagcattagctattatttctacatcagcaaccactggtattatgagcaatctctgcctttttcaacctacatgttatctcacatgtgaaaacatgttgaatcgatatgaaggagcactactaagcattgatcattttgggaacaaatagaaattattattagttatcacaataaaatttatctaatagaaaaatgta

SEQ ID NO: 257351 - DNA, 1157 bp, Homo sapiens
tcccaggtgcccgtctgatggggagatggctgatgcccagaacatttcactggacagcccagggagtgtgggggccgtggcagtgcctgtggtctttgccctaatcttcctgctgggcacagtgggcaatgggctggtgctggcagtgctcctgcagcctggcccgagtgcctggcaggagcctggcagcaccacggacctgttcatcctcaacctggcggtggctgacctctgcttcatcctgtgctgcgtgcccttccaggccaccatctacacgctggatgcctggctctttggggccctcgtctgcaaggccgtgcacctgctcatctacctcaccatgtacgccagcagctttacgctggctgctgtctccgtggacaggtacctggccgtgcggcacccgctgcgctcgcgcgccctgcgcacgccgcgtaacgcccgcgccgcagtggggctggtgtggctgctggcggcgctcttctcggcgccctacctcagctactacggcaccgtgcgctacggcgcgctggagctctgcgtgcccgcctgggaggacgcgcgccgccgcgccctggacgtggccaccttcgctgccggctacctgctgcccgtggctgtggtgagcctggcctacgggcgcacgctgcgcttcctgtgggccgccgtgggtcccgcgggcgcggcggcggccgaggcgcggcggagggcgacgggccgcgcggggcgcgccatgctggcggtggccgcgctctacgcgctctgctggggtccgcaccacgcgctcatcctgtgcttctggtacggccgcttcgccttcagcccggccacctacgcctgccgcctggcctcacactgcctggcctacgccaactcctgcctcaacccgctcgtctacgcgctcgcctcgcgccacttccgcgcgcgcttccgccgcctgtggccgtgcggccgccgacgccgccaccgtgcccgccgcgccttgcgtcgcgtccgccccgcgtcctcgggcccacccggctgccccggagacgcccggcctagcgggaggctgctggctggtggcggccagggcccggagcccagggagggacccgtccacggcggagaggctgcccgaggaccggaataaaccctgccgcctggactccgcctgt

SEQ ID NO: 257352 - DNA, 486 bp, Homo sapiens
tgttatctcctagaatttttatagtttcaggtcttaagtttaagtccttaatccatcttgagctgattttttgtatagggctggacgttcgcttaggcaaggatttcatgaccaacaacctgaaaggaaatgcaataaaaacaaagataaatagctggaacctagttaaactaaagagcttttgcatggcaaaaagaagagtcagcagagcaaacagataacaaacagagtgggagaaaaccttcataatctgtacatctgacaaagtgctaatatccagaatctacaatgaactcaaacaaatcagtaagaaaaaaacaattccatcagaaagtggctaaggatatgaataggcaattctcaaaagaagatatacaaatggccaacaagcataggaaaaaacgctcaacatcacaaatgatcagggaaatgcaaatcaaaaccacaatgcgataccacctcactcctgcaagaatggccataatt

SEQ ID NO: 257353 - DNA, 352 bp, Homo sapiens
ggctcatgctggggtctccctatccagccactgccctgccctgatttgtcctctgcacatctggtaccaactctatgcctcaagatgtgggcactggcctggcagacttcacgtggcctggctttgtatctgatgtgccgggagattcgggggatcgcgttggtgggctcctagaacgggtcttgtgcatggcccctgccaggtggcttgaattcccactgcagtcccgaggttgaggggctcatgtggtgtgtgtgccctgcaggcccgggggggctctgagtctggggctcgggctggcagtggcccaggtggctgcgggtcagcagcaccacctttccccacgcctagc

SEQ ID NO: 257354 - DNA, 400 bp, Homo sapiens
gaaacaccacagtgagcgaggcaaaaagtgtcctcctcacaggatgttcaccttacagagggagacacagttgataaacaagtaagcaaatacattaatgagaggtttcatgtgataaaggctgtgaagacaataaagtaggtaataatgcaggagatgagtagagcaaactacttaaatagaggagccgggttaatctctcattcacagtgaggatgcagtggccagaagaggcagcccagggaagatctgaggtgaaccctctggttggaaagccttggcaaattggaggaatgaaaagaaaaaagagtaaatctacaacaaggatcagcaaactccagtctacaggccaaatccagcctgctgcctgtttatgtcaataaagttttattggaacata

SEQ ID NO: 257355 - DNA, 468 bp, Homo sapiens
ggcagctaaggggacctcacttgtatggttatagaactggtcaataaacatggcatccctggaggcaaaacaggtgggcagctaagaagggtactactcagctggcaaaaaaaaaaaaaaaaaaaaaaaaaatccatccaggcacggtggcctgtgcctgtaatcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctc

SEQ ID NO: 257356 - DNA, 393 bp, Homo sapiens
gtgagacactaggaaaaggaagaagcaggcaaattgataccagtgcagggcgggaaaggcagatggatgtgtggcgctcgagaagcatgtcctcaacaatttcttctgcagttgttgcccagtaatggagtgaatggggaaatgataagacagcatgacagaaggacagcacaagtcactagacagctcacaggcagaagggagagggaagccccagtttttccgcctttacccctaggttgaatttccatttagaaaatggaaatttaaaaaatttaactggtacacaatgtatacatgcattgaaacatcacacggtaccccataaatatgtacaagtattatgtgtccattataaagaaaacttcagagaagctaaagggatggcatagg

SEQ ID NO: 257357 - DNA, 626 bp, Homo sapiens
ggttctagtaggagggatgtctttcctgcgtggctgtacacaggagaacactgtaaagagcaaggactggcattaaattctgcattaaacgtgaggcctgtttttacatttacacatacagatttcagtttgcgtagtgaaccgtgggaggctgtctcagtcgtgccttcctggggtcaaaccagttggcctgttttcaagaatgaaaaatgctttgcccgaaagtggggcgaatggtaatcacagacacacacgtctcggtgccagagttgtagctttatacatagtgccttcctgacaagtaaattactggattcctttgccaaatcattagataacttttaagagcaacaaacattcatgcaaaaggagattcagcattatcttgttagaaaaatagtcatgatttttgaaaagcaaggacattctgtgaagtttgaccaactgtgaaaattacagcctttcttccccgtacttcccccgtgcttttcaatcaatcagtttctaatggatgaagcattccctacatttgtcactagatggatgtgccggtcaattaaaatattctgacttcgcagggttgagataatagccagcctggatccatccgttactgtgaaatagaa

SEQ ID NO: 257358 - DNA, 370 bp, Homo sapiens
ctgagtgtgtgtgttttaattactgctttgtccattattgtttctgccctcatgcaggaagcaaatgaactacaaaggtgaataagccacagtctaaccttaggtctgatgtgggagatagacctaatacaactctgataaaggatagaatgacacaggagttcatgagtaatgattaaatccaatgggaagtacagagcaatggagaagactttgtggaaaggggaggatttgagctggaccctgatagtggagtggagtttttaagaacagaggtagggatgcatgtaagtcacatactcaccaaagagccatctgtgtcactgggtagtaatgggatgctgatggaatttttatacctttgcatgtc

SEQ ID NO: 257359 - DNA, 448 bp, Homo sapiens
agcagaacgcgggctctcgggtgggtccaatgcgctatggcacaccaggcgctatcgggtccctagccctctgctccggcggtggggaccccgcactcaagttccctataacctccatggacaaacacggtgagcgcgaggctaggaacagagtgagcgttatccacggccaagggacacctctagggagcaatgggaaacaaaatttcaaccaggtcggaaggcggtttgcctttctcacactgccaagccccccctgggaagccgaagccttgggggtggggggagtaggtgtcctccaaagtcctctggcccctgctccagaggggagagggacagatgtgacaaggatgaggctttgccctacaccaagtgtgccgggcaagtttgggaaggtgaagcaatctgtgacttaaataaatatcttcttagccagaaaaatgcctgc

SEQ ID NO: 257360 - DNA, 274 bp, Homo sapiens
ggagaaaaagaaaagttaggcatcaatgtaagggagtagatgatatagaagggtggaagggtagggtcctgtagggaaagtggaggggaataaaagaaatgggcgtgtggagggagagggcttgcagtttttaatcagggagacagactgtgcctcattgagaaggagacatgtgaacaaaggcttttgggaggtgaggagtccgccatgtagattgccagaggaagagcatcctgggctggcacggacctggagtttccaaagcaccacaggg

SEQ ID NO: 257361 - DNA, 689 bp, Homo sapiens
cagattttttttatatttcctcagcttaactctgctacttgatttacagtgacccataacctactcatccttggtttatagtgacacataatcttatctctttatagaaccttaaattttatcattattttcgcttagaatacagcatttctttgcttctgttgctggtttgacttaagaaataaggcagtaactctgatcaatcaattatccataaggaaggtcttttcatggtttctattaatttgttagtaccctaagtatatctgaaaaatatgtctattgagagaagattttggcattccagatggtatagtctatatatatttaaagttttgaatttgcttatatatactcagctttctttttctagcatttttgcatttacctgttaattgaagtataccccaccacatataaaagttcctcttaaagacactggactcttcctgggggttctaaaataagccaaaaagtttgatgtataaaattttttattggcctctgatgttctgtttagatcactatcctataagtaaataaatttgaaatagattcaaaatgtcctctggttgaaatctaagagttggaatgttgaggaagtgtttgatacattcttgcatggaaaagaacagtttgaaataatgtgtaatacataatacattacatgtgttttgaaaaaatcagaa

SEQ ID NO: 257362 - DNA, 387 bp, Homo sapiens
gacctgtgactttcttactgatagctcaagggggaagggaggatgtgcttacccatattctcaagccaaacattttggtcctaggaggaaaacagaagacaggtagcatgctcagctgggatttttgaagaggttttttaaggaaggaactacttacagagttgtatgcaggggttaaggaaacgaactgggtatactggggtactatgtcctacttggaagtaaatcagatatgccatactcctacagtgggatacacagccccattggcccaaggcttctcccctccccaggcttgggctaactattttgctctttcttatcttcatatttttggctcatgcttttgcctcttcttataataccttttctccctcccctttcttt

SEQ ID NO: 257363 - DNA, 480 bp, Homo sapiens
cagcacaaaggcccttgccagatgtgagccccttgatattggatttcccagtcttcagaactgtcgaaaagcccaggaatgttctagaatatatgattggcgaggaccctcactggtgccatccacatcttctcttcaggactgggaacgttggcagctgatgatcctctgggaagttccttgatacctgatgccaagtcctgaggtttttggaagtgctgcagtggaaattaggttcttcttggctttcccagtttagcatttggccttctcagattcacaagatcaattatcattacgtagacactcacattctctttgtccttgtgagtttatctctttactgtaattttagcagcatagagaggaagtaagaatgaatctatgttgagaatttacaagaacctcttaattttttacttcagaagggtgagctttatggtacatgagttatatctcaataaaaaacattttaaaaat

SEQ ID NO: 257364 - DNA, 300 bp, Homo sapiens
gggtgggggcaggtgactgggatcacgaaatcaccatcacctggagaaggcagggtaagatgtggagaagagacagatgtgggaccctgggcagatcctgaatgtctgtggagacatctagaatgccatcgtggctgggataatgaactcgaatgccctcactgtttctttatctcttaaccagagctcctgaaggagattctcaagaggacagctagacgggggaggattgcagaaagcttgacatctacagaatgctggagaaatgtgaggttgcttaccctgaagaaatacgggatg

SEQ ID NO: 257365 - DNA, 291 bp, Homo sapiens
cctcaccaccctctgatgtcccctcattactctctggtgtcacctcaatactcaccagtgtcccctcactgccctttggtgtcccctcattactctctggtgtcccctcaccgccctctggtgtcccctcaatactccccggtgtaccttcaccaccctctggtgtcccctgctctctggtgtcccaatactctctgatgtcccaatactctctggtgtcccctcattactctctggtgtcccctcactgccctctggtgtccccgcaatactctctggtgtcccctcacc

SEQ ID NO: 257366 - DNA, 208 bp, Homo sapiens
ccccccccttctttggaatccaggttttcgttccaggaagtgcattaacttgcgggataatttgctgatcacactggtacagaaaccattgagaggctttagactcctactcatagggatcaagacctggagacaaaggagtcaagggaagccccatggcctaaccacagccctaggaatatccccaatgcctaaggaaacccattca

SEQ ID NO: 257367 - DNA, 361 bp, Homo sapiens
aaaattccaattaacttatcaggtacagaaaatttatttgcattaagcatgttatttttcctcaatctctcctgtttatgactaactgcataccattcaactaacataaaagtgtttactaaaagatcagagaagttatccaccttcatagccatttggaagagaaaaaaaatctttctactctttccaaaatgggttataaacacatccctagagaaatttcaaatgaatgtattcctctgcaatttgattctgcaaaaaaatgtatgcaactgaaaattacacacagagaatatttaagtcatgactatggaaaaacaattactatatttggatacacaaattaggcaactaattattt

SEQ ID NO: 257368 - DNA, 352 bp, Homo sapiens
ttgataaagccattccaattgactgaggtgatatctcattgtggttttggcttacattttcctgatgatcagttatattggtcattttttcatgtacctgctggccatttctatgtcttcttttgagaaatgtctattattttgccaatattaaaatcaggtttgttttttttttttgctgttaatttccttatatattctggatattatccctttatcagatgtatagtttacaaatattcccttctattctgtaggttgtttctttactctgttaattctttcctctgctgtgcagaagctttttagcttgatgtaattaatttgtctatttttggtatattgttgactg

SEQ ID NO: 257369 - DNA, 361 bp, Homo sapiens
tggaattatccatcagggtattctaatcagccgccacaaatatctcttaggtattaggggctgcaggagggacccttctccagaggcatgacccatagacaaggcaatgcttaatgcagagggaccccaaacggtggcaggtcaggagagcactaggctctccaggacacatggcatggaggcagaggcctgcacctctgcgtgagctctgagctctcccaaactctgcctcttgccagctataggagagggggctgcacctggctaatttggatgggttctcttctcccaggggttgtggtcaagcaagttatcccaatgggcttgtaccttttcttggtttttattttctacactgatg

SEQ ID NO: 257370 - DNA, 110 bp, Homo sapiens
ctgaacttcagactcatatatccaactgcctactgaacatcaccatttagttgtcatcacaaatacatcatgtcctaaactaaactcttgattttctaccccaccacacc

SEQ ID NO: 257371 - DNA, 387 bp, Homo sapiens
tcctccaggctccaaacttccttccagggtcaaataagacttaccaaggggagagggtggatgtgagcaggctctcctacagtaggaagggtggcccaagtacctgaagttagaactggctctctaacaatgagagtgagactccccactctaggtctcactgggtgctttccacttctgagtcactgaagtgctttgacggaagtgaccttggtgatcacctgtgacctaaccccgcatttcacacatgaaaagagcaagtgaattctcaagattaatgtttctgtagcacagctggaaccagaaagcctcattgtttcaagagtcacttttaaaaactcacttgtctgcctggaaaataaaggatccagtgggcaactgaacaaa

SEQ ID NO: 257372 - DNA, 294 bp, Homo sapiens
atccagtgtatgcacttagcatggtacctggtatatgcacttagcataacatttagtgtgtggactcggcacagtacccagtatatgcacttggcatagtaccaggtgtatccactatttccagtgttcccatcagtccagtggcagaagtagtgaaggagttgagtgtcttgtcactggaggagtttaagcccaggtcacctgacaactcacacagatatttcactgtttacactacatgaacttttggggccctctgacaatctacaattaatctgggagcctgaaaatgat

SEQ ID NO: 257373 - DNA, 297 bp, Homo sapiens
ggtcgacggcaggcactggtggctcacacctgtgaatccagcacttcgggaggccaaggtgggtggatcactgaggtcaggagttcgagatcagcctggccaacatggtgaaatcccatctctactagaaatacaaaaattgcctggcctaatctaactttttaaatgttaatgttttctatcccttcagagtcataaactggaataaatgttccaaaagtttttctttttgttttgaattttatgttgactgattaaggtagttttaacaacattcattattagtcaccggagagg

SEQ ID NO: 257374 - DNA, 704 bp, Homo sapiens
gttggctcttgatttcaaatttatcatcttttttctcttaaatattcttctctgtataagcaaagattacctttgttgtaattatattaaaaaaatcagtgaaagcagcactttaaaaaaataataaaataaaaagtccaggtttgtttggtttggttggttttttgcccttggcatctgtcttcacatgagtcacatatttttgattcttttcatcatttaatagtaaataaacatggatatctggatattgtatgaaacaaggacaaaactacaatgcagagttcaaaagtatcctcagaattatattttcactttatcctgtttgtctcttattctgatatcctgcttacttagttaccatttctaaaaatccatatattcatttatggagatgggaacatatctcatttactgttgtattgtcagagcctaccacactcatttactattgtattgtcagagtctaccacagtactttatatgtggtaaaagtccaataaatattggataaatataatcataattagttaataagggaaaacagttgccaagagaatattatttactttctatttcaaaggacaggtagtataaagaaaattaaaatgagattcatctagagtgtgttacaggtaaaagctgttcaattaattaagaactttaataacttccagtttatggtgctataacaatttctggta

SEQ ID NO: 257375 - DNA, 680 bp, Homo sapiens
gctcatgcctgtaatcccagcactctgggaggccaaggcaggtggatcatgaagtcaggagttcgagaccagcctggccaacatggggaaaccctgtctctactaaaaatacaaaaaattagccgggcatggtgatgtgcgcctgtaatcccagctactcaggaggctgaggcaggagaatcgctggaacccaggaggcggaggttgtagtgagccgagatcgcgccactgcactccaacttgggcgacagagcgagactctgactcaaaaaaaaaaaattaaaaaaaagggaatgcacagcctctgtgtaaagtcctctctggtacccactgcacagatggggaaactgaggctaaaaagagggtgacgcccccccaaggtgtgcagccaagcagctctgtccgcattctctaacctgccgtggtacagtgagggtgggtgcttggagaattcattctcccaggcctggccttcagaggaagaggagttaggaaactcccccagggacccctgtgtgtgtatcaatggtacctcggaactgggaggacacaggtgcgacagccccatccccaggggaagccagggaccttgaggctatggatgggatgcccctgggccctgggcattggggatttagccggccccgcactcctcctaagcaggacgtggagggtgagcg

SEQ ID NO: 257376 - DNA, 359 bp, Homo sapiens
ctttgaggcaggaattgaatataaccacactagttatttatagcagctagtgatgaatgcttgaaaagtctgcttaaggccaggttcggtcgctcatgcctgtaatcccagcaatttgggaggccgaggcgggtggatcacttgaggtcaggagtttgagaccagcctggccgatgtggtgaaacctcgtctctactaaaaatgaaaaattagtggggcatgatggtggacatctgtaatcccagctactggggaggctgaggcatgagaattgcctgaacccgggagacaagaggttgcagtgagctgagatcaccccactgtactccagcctgggcaatagagtgagattcagtctc

SEQ ID NO: 257377 - DNA, 2177 bp, Homo sapiens
agctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcgctttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatca

SEQ ID NO: 257378 - DNA, 401 bp, Homo sapiens
aattcggcacgaggtcgaaattctattaactgaaatatgaaacacctaaagccctcaaaatgggcaaacgttgcgtggtgcagtcccagacccaagcttctgggagtgaaaggtgcacccgcgaccttgccttgctggctggctctgggactctgcgataagccgccctccggttgtctgcgatagctcctgaagcaggagagtgtctttcccaccctccgcctaacaggcggtatctgacccttccaggcagcagctccccagcctccggctgcgctggggcccggaaggacgaagcttcccggcagagaacctgggcagaggcgtccgttgggtaggcggccgcgacccgctcgctgcttctcccctagtcttcgggtcccttgaacgcaggtcgcttg

SEQ ID NO: 257379 - DNA, 437 bp, Homo sapiens
gccactgcactccagtttgggcaacaaaagtgaaactccatctcaaaaaaaaaaaagagtgggggatggacaggttttagagacataacagcccctggtaagcagagtgacccaaaaggggaagcaggggcaagttcggcaagttagagtgagagtaatttttgacctaacgcaggtggggaagaaaatgaaaacctgaataggtttgaatttgatcatatcgtgctggctgtgacaaccctaaatgatttacaaatggctcattaaaaaaaaaaaaaaaaaaaaaaagtgtatcatccgaatcctcaacaagaaaaaaaaggagcaagaaaaaagaattctcttttgtccctcctacccacatctttgcatgcctgtcacccctcatggatgccatcctcactgttcagcgtctagttctagatcgcgagcggccg

SEQ ID NO: 257380 - DNA, 485 bp, Homo sapiens
acaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgc

SEQ ID NO: 257381 - DNA, 437 bp, Homo sapiens
cattacttaaacatcagtttcgccaaaaaaaaaagtgcatataaaaagtacctcatgactctgttttaattagttctgttgtcattgtcattgtgcaattggaaatggtgtacactatctgggaaaacttttgtagaacatacaggcatttatattagatttagaatgtagtccttcttcgaggccctgggaaagaaatagagatgggtccttgtaaattaaaaccttacgcctcatgtgtttaaagaggcctctctgattggctaagatgtggggtgctgagtttgcaatcatttcagtgcagacattttaggagaataagtaagacttgtgcttctgtaagtcaacatttctgttctcccttctagatgatttgtttgtgtatgagggaaataatgttatgcatctgttaaaattacagtctgatcaaatcgttt

SEQ ID NO: 257382 - DNA, 252 bp, Homo sapiens
tttacaccacagaaattggctgatgctacaacccagagcttttctcctgaagctgggagtggaacattcagcagcacaccactacctgggccccatccaccttcaacccaggcagctccatgtcatctgttttatgcattgggtctggggaagatttcatttgagggagggtttaaaaaatttttaaaaaatcatttatttgttttaatcaatcctgggtataccaagtaaacctatgcattatggactaac

SEQ ID NO: 257383 - DNA, 372 bp, Homo sapiens
gtatcatttcccactggtcactaacaggagtaaagaaaaaataatcagtggagattttataaaaatggttgtttctggactcaatagactagaaagaacaagtaatactgtggtaagagtctttgttatatttgaaaaatataatgaagaaaagtaaatcttccttaaggataataggcaaacatatattttttaaattttttatgtttatatatttagtgagtacaaatgcagacttcttacatgcatatattgcgtaatggtgaagtctgggcttttagtgtacccatcacccaaatagtgaatattgtaactaataggtaactttccacctctcatcttcctcccatgctcccaccttatgagatttct

SEQ ID NO: 257384 - DNA, 513 bp, Homo sapiens
accaaaaagtttggcaatactggtgcccaggttaatgtgaaaaatagacaagggaactttccagacaaaatacagaaaatgccaaccggtttcttgcagcaacttataagaacatataaggagactaaaatacaaaaactaaagcaggaactgttaagattctaagtggaatttagaggaaatttaaaaaggccaggacttgcttgatttgaaaacagaatagttttccaaccttagtctctcttagcaaaaattctccaaagtagaaaatggcttcagcacaaagataaaacttaggatgccaccattaaagtatgggctcagagataaactgaaggttgtgactataaaccatttgttaagacttcagacagatgtaagggtatacttagccgggcttctaaatatctcatgggcacatcttgtgaaccctctcagttaaacaacaagggttttagaaatattaacatcctacaagaaccacacagggggtctaacgtagaaaagggcctg

SEQ ID NO: 257385 - DNA, 335 bp, Homo sapiens
acatacgataatattataggtagtttctgagtctgaagaggctcacaaagcctctctatccagaggactggcacatcctgcctaccacccaagtcaagctcttattcataggatggaaagtggactatagtaaaccacgtgcacaagcaaacagtaattttgaaatacagactcaataagcatttgtgacaaagcgacaagatgaaagaagtatcacattcaattaaataatgaatatccaaggaagcaaagttgataaagaaaataaagtttatagtaaatatatggatattgtcagtcttttcattatacagaaaaaaattaaacttttggct

SEQ ID NO: 257386 - DNA, 482 bp, Homo sapiens
actcactacccaggagagcagagtgataaagcacagtgcctggggtggggctgcaggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggtaaggggcttggtcccaggcaacacggggccttgtagctgggggctgatgtctgaatcccggtcccagagtgtccctaccttcacaccaccaaccgtctgtgtgtgatgagctggtcccagcacctccctgagcctgtgcccagttgtgggtacaaaaaagaaagccagcagcacttgctatgaaaagcaaagggacccaggacaccttgtgactctcctgccagctcttggtacccagggagactgtgtgtggcatcttaattatggggtttctcctctt

SEQ ID NO: 257387 - DNA, 766 bp, Homo sapiens
  misc_feature (760)..(760): n is a, c, g, or t
tactctcgggccctggcctgctgtttttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcccccttctccatatgcctccaaaaacatgtccctggagagtagcctgctcccacactgtcactggatgtcatggggccaataaaatctcctgcaattgtgaaaaaaaaataaagtcgagcgcncgtgaa

SEQ ID NO: 257388 - DNA, 1544 bp, Homo sapiens
  misc_feature (1538)..(1538): n is a, c, g, or t
tactctcgggccctggcctgctgtttttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactgggtgatcacggctcactctagccttgaattcctggggcccaagcaattttcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgaaaaaaaaataaagtcgagcgcncgtgaa

SEQ ID NO: 257389 - DNA, 360 bp, Homo sapiens
tttgctttgagagcctaatgattctaagatattgaagggttttgggtgctatgctcaggagtttggatattattgttttcaggaatttaagaatgataatatgtattgagcactaactacatgttgggagtttttttgtttgagacacagtttcacttttgttgcccgggctggggtgcaatggcatgacctcggcttaccgcaagctccgcctcccgggttcaagcaattctcctgcctcagctactcgggagccagaggcaggagaatggcgtgaacccaggaggcagagcttgcagtgagccgagattgcaccactgcactccagcctgggcgacagagcgagattccatctcaaaa

SEQ ID NO: 257390 - DNA, 105 bp, Homo sapiens
  misc_feature (7)..(12): n is a, c, g, or t
  misc_feature (16)..(16): n is a, c, g, or t
  misc_feature (23)..(23): n is a, c, g, or t
agaggannnnnngaantgttggntggatggatggatggatggatggatggatggatggatggatggactatccaatctagtgaattccatgaaatgctcaatgga

SEQ ID NO: 257391 - DNA, 288 bp, Homo sapiens
gatcaaagctgcctgtgcccaggtcgctggctgggtcatgttgttaagtcaaatgacctctcagcagacaaggggatacatgaaatgcatgggtgatggaaggggaaacagggatggtgatatgatatggttccccgtcttggagcagctgctggcctgctgtgctcagtggtttcggggttaaaaatagatgtccctgcataccttattgaggcgataggggtggtcaggtggtccagcatttacaaactaggcccgcgaggcagaatccaggtcagggtcctgatc

SEQ ID NO: 257392 - DNA, 326 bp, Homo sapiens
cctatattctgaaatatagtcaggactcattcacttggtaaacacttatggggttttcttggcctgatatagactgtgggcatgagcctccttctggaggctgtcaccagggaaggaagatgtgtaaacagtgcccagtattaggagaggaacatgtacaaaatacaaaggaagatacaacaactatttctaataaaagccacctgttttcagcacaggtagagagtgtagaaatcacagatatattcctttactcacttaatgcacccgagcagagtgtttagcagatccaggctttcagcctaaatgttgttggtgtgatagca

SEQ ID NO: 257393 - DNA, 148 bp, Homo sapiens
gagaggtttcattgcctatggctccacaggctgtagaggaagcatggcagcatctgcttctgaggaggtctcagggagcttccaatcacggcggaaggcaaagtgggagcaggcgtcttacaggacaggagcaggaccaagggggtgg

SEQ ID NO: 257394 - DNA, 397 bp, Homo sapiens
ctcatctttttccacaaaggagacaacattgtattcactctctgctcacaatatcattatcctaagagataaataatatagtttcttttaaaatagtgatatctgttccaggaaaggacttgggctgtgaattgctagggtacagctactagggatgtgttgttgggtttccccggcataatattccaccacctgtactttgacatcattgtcaattgaactcctggggaccctttcttcttgctctgatctggactctcacatgccatcttgaaatattcccccatcagttttctggtttagatttgctgtatcacacatagttatttttttttctgtctgagttcactgatatatgttctctagtgtaagaaaaataattctaattctcccatac

SEQ ID NO: 257395 - DNA, 229 bp, Homo sapiens
cttccttatagccaggtaacggcggcggatgtcggacatttgttctggaagtttggcagcaaagaagaagggaggaaggaaacagcccaggctgctgggtcgagagaaaggttctcggttgttttgttttatttgaggagagagttttatttttctggaaggaaggagacctgagcgtgtttgaggaaacagtcaatgaagagcagacactaaagactaccgtaagggg

SEQ ID NO: 257396 - DNA, 495 bp, Homo sapiens
cagaaatcaatgaaaataaaaagcttttaaagtttcccacctcaaggctgttgtctggggtgtgatttcttcctaaaaattaattttgaaaaggataaaggagggaaatttccaaacaacacaatattgttttgtaaaaatttcaacttaagtcaaaggagtgaggtttgtgaagggtcctgagagtcagattatcctcccatccagatcctctcctcttatcatggtgcaggagcattgttttatcaggtggactggagagtaagaagttacaccagatgacagttttccagataacaagctttcactttaaattctctttctaaaattttatttttttctaaaatacttcctatcattagggtatactttcatcaatcttctttccatcatgtttcagctaacgttatttgttttattcgtcagtgccataacacaggacttatgttcaatttgctggtagaatcttgttaaaaggcaggaacgtcataggtt

SEQ ID NO: 257397 - DNA, 481 bp, Homo sapiens
gggatccctgcagggtgaatgatgagagaaaaagatgttaaaaatgaaatgaccatcagtgagctacaggaaaacttcaagtagctaacatgtaatggaagccccaaaagaagaggaaaaaggaagggagaacaataatatatttaaggaaataatggtcagaaaactttcaaatttgatgaaaactataaacccagacattcaagtatctcaaagaacccgaagtacaaaaagaaagaatgaaagaaagaagagaaaaagaaagaaagaaagagaaaaggaaagaaagacaaagagagaaaaaaaaggaagacagaaagagaaagaaaaagaagaaaaaaaaaaaagaaagcaaggaagctacacactataccatggtacatcatattcaaattgatcaaaaacagtgataaagtaaaaatcttaaaagacagagaaaaaaacacccattatgtaaggagcaaaggtgatgatacaaatt

SEQ ID NO: 257398 - DNA, 228 bp, Homo sapiens
tttttaattttgtcttccagcttgaggagttattggtgattttaattgtttatacacctaaatttaaaatgatttttaaatcactatgatatacagaaagaagtaatgaaaacgagctttctattagagacttttatcacagcctctatgcttgtcactagtgctaaatcccttcctctagcaggaatgggagtagaaagatcacagtagaccaacagtcgaatgcgc

SEQ ID NO: 257399 - DNA, 425 bp, Homo sapiens
cagcaagacactgtggacgtgtgaccgctgctctgccaagtttcctctgcagacgactctgagacaactgttcctgtctcactgacagaacagtgggcaaacccaactccatggcaagtcataggcccatttagtctgaaaagaatcagctgggtgcggtggctcatgcctgtaatgccagcactttgggaggccgaggcaggtggatcacctgaggtcaggagttcaaggccatcctggccaacatgctgaaaccccgtctctactaaaaatacaaaaactagccaggcgtggtggcgggtgcctgtaatcccagctactgtggaggcaggatggatcacttgaatccaggaggtgggggttgcagtgagccgagatcgtgctgctgcactccatcctaggtgactgagcactactccatctaa

SEQ ID NO: 257400 - DNA, 414 bp, Homo sapiens
tgcttgaagtgacagataccccaattaccatgatttgatcattacacattctatgcttgtatcaaaatatcatatataccccacacatgtaactactgtgtccataaagttaacaaaaaatttttttaaagactaatgcagaaaaaagaaaaaaaaagccttctaatttcccaaactatactgagaaagagttcattcactgaatagagatttagcaacagaacattcttttttattttttagagatggggtcttactatgttgcccaggccagagtgcagtggtggctattcacaggcacaatcatggtgcctcaaagtcaaatgactctcccacctcagactacaggcctgagctaccccgcccagcagaatattttaacagtgtccattctattaaaaaaaaaaacaaaaa

SEQ ID NO: 257401 - DNA, 375 bp, Homo sapiens
attctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggaggaagagggtaatccggatgagttttctgacctactcggcggctgtgattaaacaaccaccaggaaattttgacgacactgttctcctgagctcctccctttcctccgggaacaaaacaattgaatttacaaaaataaagtgttatttgactgg

SEQ ID NO: 257402 - DNA, 579 bp, Homo sapiens
gcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttc

SEQ ID NO: 257403 - DNA, 338 bp, Homo sapiens
tccttctgactattctaacgccccagaggtcagatgttgaattgcagctttgaccaatttccatgggagaattgcacatttaaaaaaataaacttttcttcaaagctagtgaggcagagggagacaccttcatctccctcccgcccttcttagctcctccagggctggccatcctgtctgcaacgcggattcttctgcatttacacatgtgatatttacagtgaatgaaagctttatactcattattcataataataatatcaagtgcctcttagttccaggaactgtttctcttcattgcccccctctttaagttaacatgcagggaaagaaagaaa

SEQ ID NO: 257404 - DNA, 206 bp, Homo sapiens
cccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtc

SEQ ID NO: 257405 - DNA, 676 bp, Homo sapiens
cccccctctgcccccattccataaatttgtgcctgatcgctcttgaaaccaaaatacttcccacatctatttgtggttaatgatccagataaacatatcctttttacctgttgaaaaaggaccctggggagttgtacctggaagtcttggacccttcagtaactgcatgtactttttttctcttgctacaccacaaactttatttttgttaaagccttatacgagcagaccttagtgagtcctgtgagagttttcaactctataaccttgtatagatgttgtacctacctatactcctccatcctaaccaaggtgtcagactttctcatacctttcaaccaaagtaatttttacatgccagaggccctcagaaacttctaaggtatagcttgaatatttctttgacattttgtgtttatctgtaaatatataaattatattatttctcaaaatattaccatgagattgttatgctgaaaaaatgtgcatcgtatttctcctatgggtttcttatatcctcaggattccttcccagtcctagaatatccttttcggatctggttagggtgatcaaccattcagatttgcctaggactgagaaggttcaagggacatgggactctcagtgctaaaactactaaagtcccagacaaactgaaagcaaatggtcacccta

SEQ ID NO: 257406 - DNA, 478 bp, Homo sapiens
acttactataagatcataagaaggaggatgatggaaggtaacaaattgactgcctatcagactatatatcatctcagttattgtatcagtctgttctcatcctgctaataaaaacatacctgagattgggtaatttataaagtaaagaggtttaatggtctcgcagttccacatggctggggaagcctcacaatcatggcagaaaatgaagaaagagcaaaggaacatcttatatggcagcaggcaagagcgagagcatgtgcaggggaatccctctataaaaccatgagatctcatgagacttattcactatcacaagaacagcatgggaaagacccaccctcatgattcaattacctctcacagggtccttcccatgacacatgggaattatggaaactataattcgagatttgggtggggacacagccaaaccatatcagttagttatgacccaaaccctgcaagacaggctttt

SEQ ID NO: 257407 - DNA, 415 bp, Homo sapiens
acattgtagagaagagagcactcggatgtcttagaaatataattgaaatactcactgtttcttattgtctctgattaggtcttgtgcccattgttgaaccaaatgctgtgcttaggaggatgggacatgttctttttgttttgcttagttagggcctggctctggagccaggagaggggaggaggaaatgttgctggatgtaagttagcactgatactaattattctaacaatgattaatagttagaatggctgggtgcagtggcacatagtcccagctccgcaggaggttgagatgggaggatcgcctggggccaggagtccaaggctatggggcaccatgatcatgatgcctgtgaatagccactgtgccctaacctgggcaacatagcaacatagcaaaaccctttctctta

SEQ ID NO: 257408 - DNA, 515 bp, Homo sapiens
ttcttctcgaggtgctcatctgctgccaagctcagagcaaccttcgaaacccatctcaggaaacgacctgacctattctccactcccagaatccacactgggattccaaagctcctatgaggcccttgcttaggctctctagaatattcctgagcctctgttttctccctcagcctgagctgatggggccggcgtcactttatgcatcccaaggccatcagcccatctctcctggacttcggaacatggccacaatgcagagagacccagcagtaattaagaaaatttcctcaatttatattgagtgatgttggtgaacatggcaaggcacaaagcaggaaactccacagctgctgctctggacctaaagaggcaccctggacttctgggtggtgacattgcctggcttgcagaggaagacctgacccctctggtcttccaaggctgccaggatgatgacagagccttggacaggtcccagcgcaggggccatcccttcccaggttcccctggcc

SEQ ID NO: 257409 - DNA, 386 bp, Homo sapiens
agaaagtagccatcagggaaggatgactttttaaagacatacattagaattttattaaaatatatgcaaaaaatagattaaagcttttattaatatatttatggtaattgcttgtgattcttttacgtttcaaaagcactaagttttaaagagctgccattgttagtatacttgtagaaagttttaacctttaattggcatttcagtaacatttccttgaaactgatattttcatgattgatcccatgtctcgtgaatttttaacagctataaattgttactgaagaaaggtgtgcatcacaaaacagaccctccaatataaaacaatgtgtttcttactataacttggtttcagagaattaaaagtgtttatttttgtatttgaa

SEQ ID NO: 257410 - DNA, 420 bp, Homo sapiens
cacccatgtcctgttttcatgggtgacagttggcttcatacatgttagatgatgacagtcattacgatgagctaggtgtgcatacaaggctcacaatttcacctgtgtgctgtgccctgcttagattctgtgtgtgtaacccaaagactttgtaaatatgtgtgagtgttacagtcttttgtgaactttgaacgagaaggtgatccgggacatcacacatgtccctaaacctagttataagactcaatgtatcctttattggataagtccacataagagagtcattatcatgcctgtgatccatgcttaggtatatgttacaattccctctgtggttatgaagcaggcagaagagccacatcacctaaatgctgggccagaaatattccaatatcttgattgtgggtaggttccagtcag

SEQ ID NO: 257411 - DNA, 552 bp, Homo sapiens
gaatcagagcctggttaggggctgactgtcatgtactcaaggtaacgtcatgtccagcactatatcccactaattcctgggaagctgggcatcagccagaatagtatgggttcctctttcatgtatccaccagcagtgacgtagttatgtggcgaagcaaatgtatatttgaatttttcattgcttgaattgcttgtcattatcttcagagataataacatagagttttacctctaattcctaaatactactaatagcaagtttgtcctatgagcatacaaattctcaaagacctccaaatatttttttaaaatataagtagaaaaaaagaatgttttctttgtcaaagagatatgaaacttttaaaacgaaagtcttgctatggtcagatgtttattatgaggataactccctccagactactaattattaacagacgactagcagttttgcctgggtgacttgtattactcaacactacttataaaataaccttgtgccatatgacgggctttttcattcacttctgttattttgaaagaactacaataa

SEQ ID NO: 257412 - DNA, 315 bp, Homo sapiens
gaccagtagtgggagacacccataagaagaaagtgtcatgagctaggagtacaccctcagtgctcagagagagaggaactttaaagattctcttgtcggctgtgccagatgagaaacgcacatgagagataggagcaaagaaggcttcaggagaaggtgagataaactagagcagggtgtggagatgagtttggaggtgggaagtatttgcaaatttctcgttatggtaactcttcagtgtttggagggaaatattatgtttgttttctacatttaaatgtaggaaattgatactatcaagggctaaaaattctt

SEQ ID NO: 257413 - DNA, 432 bp, Homo sapiens
tctctaaatcaaaatatcgccttggttgttgatatctcttaaatctatttctagtttccaatatcttttgcccgtgcattggactatccttgtgcctttagcaaacttccctacatgatagtaactttacagtgattttattatcggacaaacaaggagacaatctgcgcctctgcaggctgctgtggtgagtctcacttatggaaggtgtgatttggggcaaggtggattaatttctgcactgagagatgcagtttctttatctggaaaatttaaggcaaaagctctggctctctcccagggtggctgtaggatgccgtgagcatccctttccttctctggtgagtaccagtactcaccctgcgcttggcctgccccattgtcaggagctgctttccccaggtgggaaaaagcagtgagccatgttcacac

SEQ ID NO: 257414 - DNA, 285 bp, Homo sapiens
aaaaatgttatacttctgggcataaatctttaaatttaagaggaggagcctttaaccttaaagtgaaatatcacagacttcaatatccagaggcaagtggataggccatataggttagaaagagctcttaaaccattctactgacataagtagccatgcaagataaccagcatctactaggcaaagccacccagtgaaaacacaaattagaagtctaagatttagtctctgcccaaaataacaaggtagagaaatgtctatctccaaaagtgacccaaaatgaca

SEQ ID NO: 257415 - DNA, 232 bp, Homo sapiens
catccaggccatccttgatttgaactaactggcgaatatgacaagtcagacttcaaaatacttaacacttaatccctactgatgaaaagtcataaccaaagtatcttttcaggaaacctattttctcccataaaagttctataattgatcatgaaaatacattaaaagaaataaagcaaaatgtgtttgtaaagtactaagtgggcaaaataaaaacaatataaaaaccatg

SEQ ID NO: 257416 - DNA, 712 bp, Homo sapiens
ttccccccaaatgcattctacataagttataaatccttttagctgttcataccccaaaccaccaattgcatctgccctccagaaaggcctggaagttccgttttgaaaccattctgggagaagctctaagacaaacagctttttcctcacaggctagcagcctcatggttgacagacgatataatttaaaataattccttgtatggcttatggtttaattttttttaagagcactgctctttcaaatacagtcaacaaaaatcatctgatattgacgagtctttttcgatatctagttccactcacttctcaccgaagcagagttgggagcagcaaatttatgccgattgtatcctttaataacaatggcacagcctctctagtcttcaagtatggcccaagctcctaagaattcctttcattttatcctcagttccagccctggagagtccagctggtctgaattagccattcgtcctccctagctggggtgtttgcatttgaactgggctggtcggcggatattcctgcaactttaaacacaggaagtccttcattcggggccagcttggggcttcctgtctccaaaacatcatggcattgttgtggctcccaggccaaccctgcgctgtagctgcaaaacaaggcgagcggagccccgcgccaggccttcggaaaggcaggcgggcgggcgggcagcagcagcggccgc

SEQ ID NO: 257417 - DNA, 245 bp, Homo sapiens
taactcaaatgagttataaatgtggatgtcataaggaaggagagctcattcttattgctctctctgccaattagcattatccttcaatataactgattttgttttccatctaaaatagactgctacttgaagatgttgtcttctaccctttcatgattgctcctcccacacaacccctgtaccctgctagctcagcacatattcgattagtaaatgtgagctgcatgattttaagctgctataca

SEQ ID NO: 257418 - DNA, 438 bp, Homo sapiens
actgattgcattgaagctttggttgggcttgaacagttttaaaaacaaccaaaacattacattgctattacttctgctgcttatattaatattttaaaaaggaatggcctcgtatatcaagggtcatgtaagtattttaccttgttaatagctcttttggaaacttatccaaagtaagaatacaaaagaaagaagttataagcacaaagcttcccctgcccagatttgttttaaaataacaaaaagtttgacgcaacctaaatgtctaacaagaagggaaaagcatagcttctaaatgaaaactaatttgatcatttaaaatgttcattacaaagattatatagaatcatggggaaattcttaagatataatgagagcaggatgtaaaattatatgttaaaatgtatgtgtgatagggaaaagtagaagggaaaattc

SEQ ID NO: 257419 - DNA, 537 bp, Homo sapiens
tgacagctgtcacatcaatccagcccagacctccctcggcagctctagaccagcagatcccactgcctcctgacaacccctctggatgtcccacagttcctcagacttagcatcctttccaaatccatgcccccatctcatttccaaaaaagaaaaatcatagaggcctccccaatacaaatgcataggacatgggaaacaaggtttgaaaggatatccagaaaagcttagggatagccctggccttttggaggtgacttgggggtggtatgagaggccagagtcagcagtaacttctcctttcttccccacgaaggtgtggacttcttagcttcctgtccttttcgtaccatttgccaaattgaatttaaataattattactgtaattgcttacttattgtctgtctctcctggttgaagcttctcaagggcagggatcatgtctgtttcacttctgtatccttggcatctgtcatataatcagtatctgacatataataggtgcttaataaatatttgtttgaattaatgaatat

SEQ ID NO: 257420 - DNA, 660 bp, Homo sapiens
  misc_feature (46)..(46): n is a, c, g, or t
  misc_feature (57)..(57): n is a, c, g, or t
  misc_feature (62)..(62): n is a, c, g, or t
  misc_feature (84)..(84): n is a, c, g, or t
  misc_feature (87)..(87): n is a, c, g, or t
  misc_feature (111)..(112): n is a, c, g, or t
caagcgtgtaaacttcggaaaatcatgggaacacagaatatttagntccagaaatcntgaantatgatcccattaccacagcancanatatgtggtaagatgttgttagtnnccttaaacatctttatggaaagttgggaaacgtatattctggggttctttgactccaagagtaataaataataaggctttcttcaaaagattttatttgaatatcattattatgctacaggaaaatatttacctttccattatttttaaataacacttaacttctgagccaaaagtacagaaataataggaaaatctctctctgtgatgaaaactcagttgagtaaaagaacaaaatacttgcagtacattgctacatattttatgatgaaggtgaaatgcttaataagcatagaagcagcagcagacagtccattgccgggctccacctcacaaagggagacatctgatctaggtctaaaagagttggccgggcgtgctgggattacaggcgtgagccactgcgcccccgcccaggagctcttttcttatgacatataaattatgacatttatattctttatatgactttatgttctcttcttatgacatttaaattctttaagtagtttgttggtccaataaactagacgttgtataatctaaaaa

SEQ ID NO: 257421 - DNA, 376 bp, Homo sapiens
gtgtttacacaatcatttccgttcagtttcataagtaaagagtataatgaggtagccactgagagccagagccaataaaacagtcacttttgtctcgacccaagaatcctgcctagacttgcaggaactaaatactttccaagggaagggactggagagaatgcagcattgtgattaccagcaacaaagagcagctttgggatgctggtacttctctctcctcacatggatgctaccgctctttctagtttaaaatgatggcagccctgaagaatttatgccctgttacattatagcatagaatgaatatataggggtacttccataattgagtttgcatataaatgtgatctgcctcagaaaattcaaactatga

SEQ ID NO: 257422 - DNA, 852 bp, Homo sapiens
  misc_feature (430)..(430): n is a, c, g, or t
  misc_feature (513)..(513): n is a, c, g, or t
  misc_feature (520)..(520): n is a, c, g, or t
  misc_feature (852)..(852): n is a, c, g, or t
agcggatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagcgggccgtgaccaccgcctccccgcgacgccccagtccagtggcctcgcttccgcccattcagcggagacctgcggagaggcggcggccgcggcctccgcaagccgtctttctctagagttgtatatatagaacatcctggagtccaccatgaacggacagttggatctaagtgggaagctaatcatcaaagctcaacttggggaggatattcggcgaattcctattcataatgaagatattncttatgatgaattagtgctaatgatgcaacgagttttagaggaaaacttctgagtaatgatgaagtaacaataaagtataaangatgaangatggagatcttataacaatttttgatagttctgacctttcctttgcaattcagtgcagtaggatactgaaactgacattatttggttaatggccagccaagaccccttgaatcaagtcaggtgaaatatctccgtcgagaactgatagaacttcgaaataacgtgaatcgtcattggatagcttggaaccaccttggagaacccaggaaccttccaccaatattcctgaaactgatactgtgcgatggcagggaagcacaaggtctgcctctgattcttctgggaaaacagtcttatcaggtattggcagcagtatgtccgctttgatccn

SEQ ID NO: 257423 - DNA, 381 bp, Homo sapiens
ttaatcactgtgcttggagacaccatgggagtggggacatctgacttcctaggcttggattccttgagagtctcatttgcttcctcacaccctgtcgccttcacaccagggctgttttattgttttataaccttctttggagctttagttgccaaagattctaatgaggctattctccactttctcactttaccaaaccccaagtcttgctgtgttaagcagtttggtcacttgcaaaggctttcctttcagatctaagcgaattacagaaacctctaggcatgtggctaccttcaactttgtccaagcccatgcacaacaatatggagggagccaagtgttaattccaactgctactcccacccccaaacccacccagcc

SEQ ID NO: 257424 - DNA, 412 bp, Homo sapiens
gatgtactgagaatcaaagcttgtatttattgagcactttctatatataaaatgttattaaatgttttcatagagacaatatcatgtgattcaaatttcacaaacaaagtaactaaggccaagagaaattaactagcctgtccaatatcagatagcaacaataagtagcagagttagaattcctaactaaacacaggaataacaaagaaataaactgtatattgaatgtatgtcatccatatgaagaagttattttaaaactaaacgtaatactggaatgtattcactatgaagtgagatgcattatcttgaatataaacctctactgtcaacaaaattaactagaaattattactcttgcacaatgtaggtttcagtttgttttttttatcagaaaaaaattggaatgagg

SEQ ID NO: 257425 - DNA, 466 bp, Homo sapiens
tgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgaccaccttgggcacatgttctcaggacctcttgagacagtgctgtgggccatggtcactcatatttggctcaaaataaaactcttcaaatattaaaaaaaa

SEQ ID NO: 257426 - DNA, 426 bp, Homo sapiens
ctggagcagacagtattgacaacaaatgagcaggtagcttatacagtgtggacatactggacaaagggatgattaacatcccgggcaggacagcccaggatggcacaagatttcatcacactaatcagaacagtgtgcaatttaaaacatatgaattgtttatttctggaattttccatttaatattttcagacacataagggaactacctattggagaagtcattggaacactgctatgtggctcacaatattaaatctggactcagacaggagcaacttagtgaaatgataaacaaaagattatattattgacttctaaataaatcaataactgatttgttattttggatgaatgatttatataactaagtaagcaattgcataattatagatgtgtgtcatacacatgtctaatttagagcag

SEQ ID NO: 257427 - DNA, 346 bp, Homo sapiens
aaatgtgaggacatgagatttgggaggggcaaggggcagaataatatggtttggttgtgttctcacccaaatctcatcttgaattcccaagtgttgtgcgagggaccctgtgggaagtaactgaatcctgggggcaggtctctcccatgccgttcttgtgatagtgaataagtctcatgagatctgatggctattataagagggagttttcctacacaagctctctttgcttgctgccatctgtataagacatgacttgctcctccttgccttctgtcatgattgtgaggcttccccagccacgtggaactgtaagtccaattaaacttctttcttttgtaaattg

SEQ ID NO: 257428 - DNA, 498 bp, Homo sapiens
ccaggtgagaggacagagagcagcagggctgtgttcaggtgcagagtccagtacctcaccaggtgaggactctaccaggtgagcaatggtctcagcctaacctgcagattgaggtctgaggccacccactgagctggaaggaagaggatttttttttttttcatggatttttcctgccttaaggaagaggattttggaatcaacaaagacatgaggccaggtgcagtggctcacacctgtaatcccaacactttgggaggccgaggcgggaggatcatctgaggtcaggagtttgagaccagcctggccaacatggcaaaaccctgactctattaaaaatacaaaaattagccagcatggtggcgtgcacctctaatcccagctactcaggaggctgaggcacgagaatcgcttcagcctggggggtggaggttgcggtgagctaagatcatgccactgcactccagcttgggtgacagagcaagactcggtctcaaa

SEQ ID NO: 257429 - DNA, 1916 bp, Homo sapiens
tgtcgctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttctaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgt

SEQ ID NO: 257430 - DNA, 400 bp, Homo sapiens
tgtcgctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagcatatttccttcacaaacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagttttccaaagaaagatttgatatagctattatctattacgccagacca

SEQ ID NO: 257431 - DNA, 1896 bp, Homo sapiens
tgtcgctctcgtagttagagaggcccggatggaggacgcagaggcacgctgttgccatggcagtgtggtcctggctgccgcggaggcaggtgccggggtctcctttgcctcaatgtgaagagcttagaaagaggaggagaggagaactcccccggccatctctgtgatcccagccgccgcattttacacagaaaatgaatgaaaataaagatactgattcaaagaaaagtgaagaatacgaagatgactttgaaaaggacctggagtggttaattaatgaaaatgaaaaaagtgatgccagcataatagagatggcttgtgagaaggaagagaatattaaccaagacttaaaagagaatgagacagtaatggagcacaccaaacggcattctgatcctgacaaatctttgcaggatgaggtctcaccaagaagaaatgacatcatttctgtaccaggtattcaacctttggatcccatatcagattcagatagtgaaaactctttccaggaatccaaactagaaagccagaaagacttggaggaggaagaggatgaggaagtaaggagatatattatggagaaaattgtacaagctaacaagcttctacagaatcaagaaccggtgaatgataaaagggagcgaaaacttaagttcaaggaccagttagttgatttggaagttcctccactagaagacactactacttctaaaaattattttgaaaacgaaaggaatatgtttgggaaactgtcacaattatgtatttccaatgattttggacaagaagatgtgctcctgtcacttactaatggaagctgtgaagaaaacaaggataggacaatactggtagagagagatggaaaatttgaacttctgaatttacaagacattgccagtcaggggtttttgcctcccattaataatgcaaatagtacagaaaatgaccctcagcagttgttacccagatcttccaactcctctgtcagtggcaccaagaaagaagattctacagcaaagattcatgctgtcactcactcatcaacaggagagccgctggcttatatcgctcagccaccactcaaccgcaagacttgtccaagctctgctgtcaactcagatcgaagtaaagggaatgggaaatctaatcacaggacacagtctgcacatatctcaccagtgacttcaacatactgtctttcccctcgacagaaagaactacaaaaacaactagaagaaaagagagaaaaactgaaaagagaggaagagcgacgaaaaatagaagaagagaaagaaaaaaagagagagaatgacatagtatttaaagcgtggttgcaaaagaaaagagagcaggtcttagaaatgaggagaattcagcgagcaaaggaaattgaagacatgaacagtagagaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacaatggttaagaaggaaacggatggaaaaaatggcagagcaacaagctgtcagagagagaactagacagctccgactagaagctaagcgttctaaacagttacagcaccacctatatatgtcagaagccaaaccttttcgttttactgatcattataactgaaagtttctattaaatatttcagtgggcagctgctatcaaaattttggatatgatttcttagggtctgtgtactttggttgtattctaaattatggaaatggtatttatcttttattgacagtgaatttgtttttttaatactagaacaaaataaatttttttctcacagtgttgt

SEQ ID NO: 257432 - DNA, 418 bp, Homo sapiens
aacaaaggatagtgggacaactggatattcacatgtgggagaatgaagctagaactttacctcatactatataaaaaagttacccaaagtagatcaaatacccaaatgtaagagctaagactatacaactcttaaaagaaaacatagatatgaatcttcatgaacttggatatgacacaaagcacaagcaacaaaaggaaaagtagattgattgcacttcatcaaaagtaaaaactttttgcttcaaaggataccatcaaaaaaatgaaaagataaatgtgaagaaaaaagtgaaaaggggccagatgcagtggctcacacctgtaatcctagcattttgggaggccagggcaggaggaccacttgaggccaggaattcgagaccaacctgggcaacaaagtgagacctcatctctac

SEQ ID NO: 257433 - DNA, 696 bp, Homo sapiens
ggaaaaaaaaaacacaacgtagctggggctgggcgcagtggcttacgactgtcatccaggcactttgggaggctgaggtgagtggatcacctgaggtcaggagttcaacaccagcctggccaacatggtgaaaccctgtctctactaaaaatacaaaaattagctgggcgtggtaccacgcgcctgtaagcccagctactagggaggctaacgcaggagaatcgcttaaacatggcgggcggaggttgcagtgggctgagatcgcgccacttcactcctgcctgggcaacgaagagtgaaactccatctcaaaacaaacaaacaaacaaacaaacaaacaaaagcactctaggtataaaaggaacttcctctgcctgcaagaccccccatctccttcccatgaagtccttaacttctgttcaacccaaacgcccagcgcgtcccttccactgcgctgcccgatgcacctcttcccgccacgccttcagtgttgtggtcatttgtgcctgcgcacccagggctgcaggtaccttcctcctgtgtgcttccaggacggttattcaggatgctgagacgagccgccagctcacacagaactggggtgtgacctcagcacctgctgcctgtgttcctgaggctgtccgccaaggcgctcaggaaacgcacatgcctcctgagcctcatatgcacacctcg

SEQ ID NO: 257434 - DNA, 272 bp, Homo sapiens
acagatgacttatacaaatttgtattattgtttgaatagtgcccacttaatgcagatagttatgaggctactagtcctatttgcactatttatataaagtgtttagcccagggatttaagttctcaagtgctgttgtttttatttattgtatttgttttattgtagtttttagagatagggtctcaccatgtcatccaggctggaatgcagtggtacaatcatagctcacttataaccttgaactcctggtttcatgcagttctcctgcctt

SEQ ID NO: 257435 - DNA, 438 bp, Homo sapiens
aaactgacacagcacatagacacaccacatttactctgttgctttcagtgtgactaacccaaaggaacctggcaagcaggagaaaccagacctcccggcgctcccaagccacatccctatcctggcttcttccccatagagtctaaatcatctaaaggaggtgaggtggccatatgtaccttacaggggtgttgtatgactttgaagaaacaataaacaacacaaacagaagtccccagcttagtcctgggcacacggcaggtattcaacacgtcagctgtccacctcaacctcagcccacctccaccagctctagcatacattctacagaagacaaagttaaaaacagaaaagtaggattgcctgaggtcagcagttcgagaccagcctgggcaacatagggagaaccagtctctatgcaaaataaaacattttaaa

SEQ ID NO: 257436 - DNA, 191 bp, Homo sapiens
ctgtgtctgtgcctttgctgggaagctggtgatagagaccatggctgcacgactgccagctttcatgtggctcggttgacaggggtttcaccctctgatgaagttctccaaactttcttggaaaaccagctgggcaggtttaccttttgtctactgccttggatggatctcatttctatcctagtttgggg

SEQ ID NO: 257437 - DNA, 366 bp, Homo sapiens
cctgtaaacaacttttgaagcaggttttgatcatccccatttacagaagagaaaacagcctcagagaggttaagagacttcctctggatcacacagctaatgtgcactaatggggctttggagggtggcaacaggaggcccggtgaaatccccggtgagagcagccttttcgccgtggcctgccgtgaagcactatggcagcacccacacctgccaggactgaagatgaagaaaccgaggcccagagggactgacgcacttgctcgagacctaccccaagccagtctgttctcttaacgtctattctgcagtttgatatgtgaccattcacagtgagcttggtcaatacaaagatgttcccagaaa

SEQ ID NO: 257438 - DNA, 492 bp, Homo sapiens
ccagtaagtgctgatgcagaagctacagcaagtcatcctaaaaatctagccaacaaaattaatgaaagtagctacactggtcaggcatggttgctcacgcctgtaagttcagcactttgggaggctgaggcgggtggatcacctgaggtcaggagttcgagaacagcctggctaacatggtgaaacccaatctctactaaaaatacaaaattagctgggtgtggtggcgcaggcctgtaatcccagctattcaggaggctgaggcaggagaatggcttaccaaggagacagaagttgcagtgaacggggattgtgccattgcactccagcctgtgcaacaagagtgaaactccatctcaaaaaaataaaaataagaaaaaagaaagcagccaaaccaaacaacagattttcaataaagacaacatagacttctattgtaagaagatataatctaggactttcatagctatagagaagtcagtcaatgcctgg

SEQ ID NO: 257439 - DNA, 306 bp, Homo sapiens
  misc_feature (171)..(171): n is a, c, g, or t
  misc_feature (245)..(245): n is a, c, g, or t
agctcacagcctcactcccccctcttccttgatcatccctcgcacgctccccactcagagctttggcacggtgcctgctgttcctccacctggaacattctttttgcagggatccacggacctggctccctcatctcccccaactctcatcttcccagggggttcttcctnaatcactccacacaaagccacagtacccctccccaaccctcagtaccgaccctctaccctcttttcacatactntgcattttgattcctgtacactgtgtagctcaccacatcaagtggtgacatttatgaagct

SEQ ID NO: 257440 - DNA, 545 bp, Homo sapiens
tctccttctttctgcttctctgatcccttttttccccaaagcactagagtgactttctcttaagttcccttatctaattaagggaagttcttccagaagaaatgcaattgtcttaaaactctgtctctagtaatatgaacaaataaccaggaaagattaaccacaagaagagaagagattaaaacttgtcacatctagatagacttttcatgtatttttctggagatagctccaagaaatcacctgggagacattatctgtataagacaacctttgttcacagtgaagttttgcctctcaccttcacaccacctcccccagagctcacaggaactctttgtccaaggccattgttccttgggctcattaattttccccaaaaatcatttactacccctcacaattggctacatttcccccatttccctctcccttatgaagaggatatgtaagcttcaactctctggcctttctttgagtctcatatttaaatggctactgtacttactcacattttaaaaattatctgccttttctcctattga

SEQ ID NO: 257441 - DNA, 420 bp, Homo sapiens
ctgcccccgtaatgcaatgggcatcttcacgaagaataagctccttttcacttaaaaatattcagagaaggagaaacaatgtgaggcagtggaaacagcatagggtttagactcagagaacctatggtcaaatcctggccctgctgcttgttagctgtgtgacctcggagaagtcacttactctttgagcctgtttcttcatctgtaaaatgggtagcagatgagccacaaagaatgactgtgatgattacataacagaaaaactccaggtacatgtctattatgcccattatcactggtgtccattcccagggtgttgcagaaatgttgcctgcttttggtgaacatttgaacacaatgttctctgaggttcctaaatggcaggtatgatcttatttacaagaataaacgtgcctacca

SEQ ID NO: 257442 - DNA, 695 bp, Homo sapiens
gttgatttggaatgtagagtggatcttgatttctagaaatgcagattgacactcactaaacattacatgtgtttaaactaaagagaagcatacagagggcatctggtacagttcctggcacttccacatctataaatcacaggaagcaaaattatgtaagaaacatagctttccctctcctggcttttattttttgtttttatttttagagacggggtctccttctgtagcccaagctggagttcagtggtgtgatcatggctcagtgcagcctcaacctcctgggttcaggggatcctcccatctcagcctcctgagtagttgggactagacgggatctccctctgtagcccaagttggagtgcagtggtgtgatcatggctcactgcagcctcaacctcctgggctcagaggatcctcccatctcagcctcatgagtagttgggactacaagtatgcaccaccatacctggctaattttttatttttgtaggggtctcgctatgttgcccaggctggtcttgggcaacataccctcctaccttcttggcctcccaaagtgctaagattgcaggcatgagctgtggtgtctgacgcatcttctatcttttaaaggcatatatccaagtggtcagtattttcaatttaagttcttaccatggctttccaggcctacaaggtccacctcctgtctc

SEQ ID NO: 257443 - DNA, 301 bp, Homo sapiens
atgaaaaggttttttataactctcataatcagctaaatggtgctaataattctctagcaggtctctgaaatgctagagaaggcttttcatggagtgtctggcaacagtgatgatccatgctcatttgtaacccagaagcagcaattattatttttaattgctatgatttttcaaaataattcaaacaattcttcttctagtatgtcttttaaaacatataaattatttaattgcagagttagaaagaaatttagaaaataatttgatggtgggtttgccaacatcaaatgctgcttcagga

SEQ ID NO: 257444 - DNA, 370 bp, Homo sapiens
tcaagtagatcctgcctgcttctgagtagatcctttctgcttctttgtttcttaagatatttctggccgggcgtggtgactcacacctgtcatcttaacactttgacaggccaaggcaggtgcatcacctgaggtcaggagtttgagaccagcctggccaacatggtgaaaccccgtctctactaaaaatacaaaaattagctgggtgcggtggcacattcctctaatcccagctactcaggagactgaggcaggagaatcacttcaacctgggaggtggaggttgcagtgagcccacatcaagccattgtactccagcctggatgacaagagcaaaactctgtctcaaaagaaaaaaaacaaaaaatat

SEQ ID NO: 257445 - DNA, 506 bp, Homo sapiens
acatttgcattttcggccagcagcttcttgatattctcagataacaactgaagccgatgtgttttggttgcgaaaatgttcgagaagctatttagatgtaaagctttctgaaattcctggcatgccttggtaccatcttagagattctgtggaatgtgatctaatctgcagctgtgtagacctcacgaaatgaccaccgaccacagatgcaggacttccaagccctgtgtttgcttgcttgctccttcccaatgagtgaccactctcagttgttgttaaaaggcctgtttctaagcagctgaggttctgtggtttgaggcagcctaggaaaaaaattaattttttttttcgagacaggatcttgctctgttgcccaggctggagtacagtggtgtgatcttggctcactgcaacctccacctcccatgctcaagtgatcctcctgcctcagcctcccaagtagctggaactacaggcgcgtgctaccatgcctgcctaattgtttt

SEQ ID NO: 257446 - DNA, 368 bp, Homo sapiens
tgatggtcaagagaaagcgattagaaaatagtccctactttgcatgtgatagccttgagtagcaattaaagtgagtgttttctcatctttgacaaagacgttagcaaagatgatgatgaagataatgataatgatgatgaaggtatcttttgccattttactcaagcagctactcttaaattggacattttcttctttaattctctcagcaagtctgcttaggaactattaccatctgcattatgcaaatgagaaaactaactctcgaagagtttaaataactctcctaaaggctccacatctagtaagcagaagcaatttatgatatgcccttcacctctgtggtgtgtgtctttttaaaatcataa

SEQ ID NO: 257447 - DNA, 455 bp, Homo sapiens
gcccattcctcactgccttcttgctgtgtcactgcatggtgggaggggcaagcaagctcccacggcctcttttacagcggcccagattccattggtgagggttctgccatcatcacatcatcaccacgtcaccttcagggctaggatttcaacgtaagaattccggggggccgggtgtggtgactcacgcctgtaatcccagcactttgggaggctgaggcgggcagatcacgaggtcaggagatagagaccatcctggctaacacagtgaaaccccgtctctactaaaaatacaaaaaaattaaccgggcatggtggcaggcacctgtagtcccagctactcgggaggctgaggcaggagaatggcgtgaacctgggaggcggagcttccagtgagccaagatcacgccactgcactccagcctgggcgacagagcaagactctgtctcaaaaa

SEQ ID NO: 257448 - DNA, 148 bp, Homo sapiens
aatatactgcatatgttcaagtatgtagaggaaaaaaaaagagtatgataaagagagtcatggaagatataaaatagacatgcattaaatttctagagttgaaaaaatatgatacagaagatacatgagagggataaacagcaaccat

SEQ ID NO: 257449 - DNA, 189 bp, Homo sapiens
gataaacaaaataaaagtgaagtcttaagtagaactttgcaaggagtagcagtacactatacggaggtattaggtttttttgaatatgacttgaagttgttaaaatgatattttagagttttgatgtgcttaaaaactggaaattgagaatttttttttttattttttgttttaagttaaaaattaagc

SEQ ID NO: 257450 - DNA, 414 bp, Homo sapiens
cttgccacgaagccgatgtggaaccatcgccgtgctcagtggagggaccatgagttcatggcgtgattagctgggaggtttggaaacagcaaaagcaaaaaggcatctcccacaatgtccagtgactcaagtctacagagcttgtgtgcaaattcccttaaagtccctcctcatcttcagaagatatccaatgactcaagtctatggagcttgtgtgcaaattcccttaaagtccctcttcatcttcagaagttgaaataggaaaggaaaaggcaacacttagaccaaatgctgaagtcaacgtgacatgtaggatgtgatttgttaagttacactgacatctggtggccttcagtgttagaagagaaacacacgagatcctgtgatctgaaacacacatgatcaaatgtgcct

SEQ ID NO: 257451 - DNA, 400 bp, Homo sapiens
tcatgtcttgacaaaagatatgacagaattttcctttaatcataattgtagtggctgcatgcaaaaaaagaaaatatatccaaaatacaatgaataagcagggaaagagtgcaaaggaagtgaatctcccttctctatttaatatagttgactaatttgtccccatgtgtaccaagatatgtttacctgctgaataccctgagcaaaacaaaacaaaaccttcttaggtaagatgagtgtattcactgaagtggccttcaactagggatcatttctaaaacattcttggtactttcagctgacagactacatgcctctaagctgtttcatacttaagagactgaattcactggaggtacttaaaaggatgagactgtataatggttgatcatttcagctg

SEQ ID NO: 257452 - DNA, 1128 bp, Homo sapiens
aagtgaagactgagtctgaaatgggaaagatatccccacacaagtccagcacaggctgttagaactctatatctcttgttctggaagctttgaagtccaagatgaaggtggcagcagcttgagtgtctgggtccccagtttgaaatgtcttgttactgctgacaagacctgcatgactgaccatttgctccctaagagatgaaaactgacattgctttgaagttcaaaatgacattgccaaaacaagaagaaatggaaaataactgcagcacgtttatgacattcgtttctttctccacatgaaacatacaatgagaacactttatagatgaattgtgtcttcgattgaatagagaatggtggactagctttggttttatggaattggataatttgtcatagtttctgtccctggaaaaatgagaacccaaaggaaaacaagtggaaagcctttaaaaaatagtgatataatacacagctgatatttttggttcatagaatactttaaagtacatcatttacaaagcaaattactaaattataagaaatgctgtcatcatcaataaacattcacagagcttcaggttttaacacaaagcattcctcatatttcaggtgatattatttatgaaaaaattacttggagattgctccaaggttatcacattcttttcaaaccatcaattccctattattatttactattattagttattatttataaatacatatgaatacacaatgaaagcatgctttatgtatagcatataaatatatttgaactttactttccccacatactatctatcctgcaatattacaccaccagtaaaagagtatctaaatattaattgctcctatcacaatagtggaaactagaagagataagttttcccaaatctgagtagaaaaccatggttagcggatatccatttgtcctttacggaatatagcaataaaatccaccaataatttttagttgcttattatgtagtgggcaaacataatgtctttttctcacccattccagggtcacagctgacttcctttaacaaaaaccagatgaacaagaaaaatgcataatgtgttcatttaataaagttttaagtgacgtgggagccttcagaa

SEQ ID NO: 257453 - DNA, 1017 bp, Homo sapiens
aagtgaagactgagtctgaaatgggaaagatatccccacacaagtccagcacaggctgttagaactctatatctcttgttctggaagctttgaagtccaagatgaaggtggcagcagcttgagtgtctgaaacaagaagaaatggaaaataactgcagcacgtttatgacattcgtttctttctccacatgaaacatacaatgagaacactttatagatgaattgtgtcttcgattgaatagagaatggtggactagctttggttttatggaattggataatttgtcatagtttctgtccctggaaaaatgagaacccaaaggaaaacaagtggaaagcctttaaaaaatagtgatataatacacagctgatatttttggttcatagaatactttaaagtacatcatttacaaagcaaattactaaattataagaaatgctgtcatcatcaataaacattcacagagcttcaggttttaacacaaagcattcctcatatttcaggtgatattatttatgaaaaaattacttggagattgctccaaggttatcacattcttttcaaaccatcaattccctattattatttactattattagttattatttataaatacatatgaatacacaatgaaagcatgctttatgtatagcatataaatatatttgaactttactttccccacatactatctatcctgcaatattacaccaccagtaaaagagtatctaaatattaattgctcctatcacaatagtggaaactagaagagataagttttcccaaatctgagtagaaaaccatggttagcggatatccatttgtcctttacggaatatagcaataaaatccaccaataatttttagttgcttattatgtagtgggcaaacataatgtctttttctcacccattccagggtcacagctgacttcctttaacaaaaaccagatgaacaagaaaaatgcataatgtgttcatttaataaagttttaagtgacgtgggagccttcagaa

SEQ ID NO: 257454 - DNA, 432 bp, Homo sapiens
ggaaaagaggcagacagggaggtgagggggaatgtgggaggtgatgagaaagaaggaaaaagaagaaaggagatggagagagtgatagggagacaggaggggagaaggaggaacagataggagggagctatgaaagaaagagtaaggttagaataaagatttgggaaggagagggaggcggaggaagaaagaggaagggagggagctggagagcaagattttgaaactcttaaactaagaagagcaaagcagctaatatgtatggagcacctgctaggtgtcacgcattgagctaggtgtcatttcattattatttgatctcatgctaacaccaccttggtgttatctccctcatttttataggtgagggatgggtgctctgagtttcaataactttgcccagaaccacagcgttgaggctgtagggaggtt

SEQ ID NO: 257455 - DNA, 727 bp, Homo sapiens
tagggatgggttctcactatgttgcccaggctggctttgaattcctaggctcaagcaatcttcccacctcagcctcccaaagtgctgggattacaggtgtgagccaccgtgtccggccttattattagttattgttattagtctcttactgtgcctaatttataaattaagctttatcatagacattatgtataggaaaaataatagtatatattgagttcagaactacataaagtttaaggtatccactggaagtcttagaacatacccctgaggataaggggtggggggcagttatgtattattacatagcctggaggatcatgtggaactccaattagaaaagaaaaaataccttttccttctgactcagaggccaaatgttcttgggtaaatgaagataaatccccagcttagatatcaaatttatcatcatgtgggaaaggcctctttaacagagagttttccagctttctgggggttgggaggagtcttctatcattcctcagacacagtaattggccttcaaaggacctctccacatctgaggctcataaccccagaggcctgagtattctgtctctgggcctgacctattttagattgtgcattctaacccacagtaaatattaaagtgttatgaattgttgagcacctaacaagtgctagtcccttaaaaaactaaagtatggctttagttctttatttcaaatcctcatgacaacgc

SEQ ID NO: 257456 - DNA, 384 bp, Homo sapiens
cgagattttgaatttaggtctggcgttaacaccagtggcattgtgtctccttagtagtatggtagaaggaaaaacctcccattagctcaaagcaactgttctaactctatcaactcacatggctctgcagcatgtggctggatttcatattctcttccaggcagggttggtaacacatggtcagtgtttgagcattgcacagatcataacttacaggtaaatttatcatttgtgtgtgtgtgaaaaccaacaaaaagaggaaaggcttgttacttgttcaagggagaggttctacagcatttgaatttgtggctccctgcaatgagttaattgagaggagactatccatttattagaatttgaaccgccccacagccatgcata

SEQ ID NO: 257457 - DNA, 390 bp, Homo sapiens
gcaggcaaagaaatgttatgattggacttattcatgagataccacagtctctaatatatgaagtttttcatatttacactactggtgaatctctagttgtatacctgcctctgtggtctcattgttggtccctaggatagcttataaataaaaacagatgatactgtctactggccagaacaagctcacaactcactttctactccattctcaagtgactatgtagagaaagatggatggttgaggtcaggatttggagttctctggctaactgcatattaactttgttatcatcgccaatattatcacctgacagagaaacagacttgatggatttgggctttagccctgacttcatcacaaataaacagtgtcatcttggatgctaac

SEQ ID NO: 257458 - DNA, 3700 bp, Homo sapiens
  misc_feature (836)..(836): n is a, c, g, or t
tcatcaggaaggaaatgaggcagcccaaggaggcgggagacggggccctacccagcacccagccatctgcattgacacggctgcccgcaggatatcactgcccccatcccggggcccaccattaccagcagggagagggaggcaggtgagcaccccgagccccacgcctcctgtcgcggggactccccagacccaatgctgtgccagtgcaggccaggcagggggctgaggccgaggcctggtcattgccatcctggtcacgatctggtgaaggatttgagtccagaagccaaacgtctacagtcgtgtggtgcggacactcaggatggactgcccaggccatggggggctctgagggatgaagaggaaactgcgggggcgaggtgggctgcgcgtctctgagaaagtgtgtgagttgagtgctgctgcagagggaagctggggtccaccgctggtgagcggggaggggacgggacacagaaccggccgtggcccaccccgagacggaggcgcagacaccaggcccgttctgtgctctggaggctttgggcagctgtcaggctagtggacggtgtgcagagcagatggaggcgtgaggaggcggctccggggtcacctaggtgggcagccctcacaggggaggccgagggggagggcaggagggcggagcaggcggcggtgcaggaggcccgtggaacttggagggctctgtgtccagctctcatggcccagggcgggggcagctccaaggcctcgggcttggggacagaagggagaggacttgggggttgggggtggtcagagcattgtgggagggatctggggcagctggggcntcccagagggtgaggtgtctgctgggaattggggcagccccaggcgtcccaggcctccagcccagccccggttcctccacgctgcaggccagggtatcaattgcctgctgggaaacctcagggtgcctctgtctcaagtgcctgcccctgacactcctggccctgggctccccccgcctccccgtctgtctgctttccccacctcctcccctcccctggccgtctttctgactcggggatggcgtcacctctcaccccaaatcaggaccctgggccccagctctgttccccacctcaccttccttgtgaccaactcctgacctcccgtgggcttggggtgtctgtggccggaacattcctcagaccctctcctccagccccactctgtcccaccacccaggcatcccccacctgggttccagccctccaaggggccccacgctctgtgtccatgatcaggacactcacacgcacccagctcgcgcccttccttccagacattcgagctctggaagctcacagtcaccctagcttagtgcacagccacaggccaggcaccttcaacatccccaccttccaggtgaggaaaccgaggcaccgagagctgggggccaggccagggggtctccctggggggagcagaggagtgtcggacctcagaagaggctctgggggtctgagccgccaccgggcgctgccttccaggttcagcagggacagagctcagggggaaggcacctcccgtcctggttcaatacatggacccctgaccctgggaaagggactgagccaggggaggcctcaggtcactgcaccatgaagttgtggggagctgcgggggcctctgggctccgagctgggcaggcacagcgtggggaccacgtgccgaggggaagaagcgtgccagggtggacgtctcagtgcacacgcaggaacatgcaacggctgagccagcccagagaggcagcggagcgtgtgcggggcggccggcggaggagcagcaggatcccaggcgggagcgcacggccttttcggaggcaggttccaggacaatactaagcgtttacatcattgcactatttgatccaggaggtcccactgtggcgtttcatcgataaacgcacatgcgaggtggagggtggctggtgtggaatgtgcccggcagccttcatagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccggtcaccccagccctgggtggaggcccattgaggatggccgagcaggggcgggcatccaggcaggtccagcagtcctggcgggctgaggagaaggaggtcagtgctcagggagacatccgcagagggacctggcaggcagagctccagaagggagggaactgcacagacagaaagctccagaaggctgcctgagggcctctgaggcctccggagtcaggcgccatggatgtggaaggtggactcttcagcatggatgggaccctagggggctgtggacccccggcccctgggactcacaggtgggagacaggagttccaaccgccagggggagagtcctggaggatcctgggctgttggcagccacccagcagggcccgtcctgggagtggggctggactcttcctgcaggaaaggctgggctggacctgctctgagaggcttcagaaccagccacacgaagaccaaagtgaagagcaaggagctgaactccacgcagaacacagcgcagcgtcctttaaaggaaggccaaaaacaacccaacaaaaatgccaggtgatcaaagcggtcacagcacaatgtccacatccaacgagaaattgctactacgtccagacgcagggaaaggtggccgtgggaacgtgagtcagcagcaacaggcccagaagggcagccacggtggacttgtcagacgtggaccctgaaatgacaatcacagcatgatttcaggcaggagcctgaaatggtacagctttggacatcggtttggcaaattcttttagagagaaacacacaccttccctaggacccagcaactccactcctaataaccaagtgaaatggaaggagttgtcctcagcaaaacgtgtgtgcggaagttcacagtcactttctcggtgataaccaagagctggaaaccactgcaacacccaccagcaggtgaacggattaacacactgggctagggccacacaatgagatgctccgtggcaacacaaaatgaaccgtggacacacactgcacggcggatgaatatgcagacatcaggccacgtgaagggagccaggccccgaggcgccacgctttgtgattcagggtggtccctctgcgcccaagacccggctgcctcctcctcttcctggctgcagggagtgcttgtgtctgaagaacgccaggctggtgtccccagagggcggctggaggggctcagaaaccattttcaccttctgtctcctccatgtctgcactgtttgggtttgtacccgcctgtgtcgcttttgcacgggaagtgagatggagagacacgtgaaccaccattgctggggttccagcatggggccccaggggacccatggctttcccagaaggaagctctgccattggacagccggtctcaggctgctgcacaggcccctccccgccctcagccctggcctgcgggaatcaggaaagggtggggtccagctgcattgcgaatggactaaagccactgatttgcacacttgccaatggctgaaatggtcaataaaacgtcatgtaccttt

SEQ ID NO: 257459 - DNA, 505 bp, Homo sapiens
tcatcaggaaggaaatgaggcagcccaaggaggcgggagacggggccctacccagcacccagccatctgcattgacacggctgcccgcaggatatcactgcccccatcccggggcccaccattaccagcagggagagggaggcaggaaagaaagcacgcagccaaagagcgcaaagaggctcagaggaggcccgggtgccctggagagacgctgcgtcctgacgacacagcatccctgtcccgcagcggagatttcccagatgaaggattccccggcgggagacagggccctgcacacaggtcctctgccacgctgctcaccatgcctgtgtgttatctccccatgaaaagtcacctaggccgagcatggtggctcacgcctgtaatcccagcactttgggaggtggaggcgtgcggatcatctgagatcaggagtttgagaccatcctgagtaacatggtgaaaccccgtctctaggaagaatacaaaaattaactgggcatgg

SEQ ID NO: 257460 - DNA, 376 bp, Homo sapiens
agcaactcattccattgcatactcaaggccatggtaccaatttttctgacctttgattataccaaatattacatagctgaacataaaaattttggttatatggagatgtaatacaatatttaatacacataacatgtattaacaatgcataaatataatttcatgatatttctgaaaaagtaaaatgttcaaagaaaattcctgtcttctatattacccctccattttcttttgacaattaaccctgttccaactatagttcacatacggactgtgcaaccatgtattgaaacaaggaagaaaacagcccatatatctaaagatgaaaatagactctgaagttccatgtatcaccaacgtttttacattgactctt

SEQ ID NO: 257461 - DNA, 473 bp, Homo sapiens
cagttttcttaaagacttttcttatgaggaacttgagacaagttctctcaagggcaagacagagaaatatgactatagtacttcaaattatagtattaaaatatccccaactcttaattctgaatgtgtcacagacaacacaattctctccaacaaattcgtaaagtaatagcatactccatataaagtagtccataaatggatatgaaggtactttttaagtcattattttgttttagattctttagtcgggcatcctggtatccaactataagacgaaagtcatcttaatcgtttctctgtatgcaaataaaactactaagggctcattctaatatgccagagttcacgaggtgagaatatgaattaatttacaatgactcttagagtataaaattaaattaagtaggaagagcataaatattaaatcagtgaaacactgtcagcaccaggaattattgctatttttattg

SEQ ID NO: 257462 - DNA, 239 bp, Homo sapiens
gggttaagagataatttatttcaagtacttacaaccttgcctggtacatgataaatgctgcataggcattttctattattattacctgcataaagaccactttgagaaaggttattaaagccctcttcacctgttcctcccatcgcctatttatatctacttgttctcacttctattatctaatcttgtacgtgtttccaattagctctcttgtatattttcatcatctttccatgctc

SEQ ID NO: 257463 - DNA, 658 bp, Homo sapiens
ggagaattgcctgaacccaggaggcagaggttgcaatgtgccaagattgtgccactgcactccagcctaggtgacaaaagcaaaactccatctcaaaactataattatgtcagtgtgtagaaaaataataagttgtaaatcattaacataccaatacaataatataaacccaattgataatctaaagaatgttgatgatttattttaaaaccaagattatattgtcttattattatttactatagttttatagttatttatatatgttcttgtggatattgttgagatacaatttacatagaaacaaaaatacaatcggaagatataaagtatactttagtctacattttgcgttttggagtttgcttttattagctttgaagtagttactacaggaaagagcagtttcaaaaggaaagcgtggtgaaacaagagttattactccactgcatctcagaaaacttccctgcacaaagtaaaatacttaacaagtttctgaagtattacctaatgtagacttatgtagtattttgaattatttttattaaaacttcttatgaaattaagtcagtacccctcttatatgtgggcaaacaggaccatgctgtgggccacattctttccagacccctctctgggtattctcctgtgcaactgc

SEQ ID NO: 257464 - DNA, 410 bp, Homo sapiens
aactctcctatacctggagatgcttatgttaatctctaaactgtacatacctctttatgtgaaactgagctgtggggcttccatgttcacccctgttgtatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtgccggtgcttcagccacctagcttaggtgtgggaaatgtttgcagagagaaatagggcagctgatccccttaagagactagagggtggggcagtgggcaggacacctgtgcctaaagaacagcttc

SEQ ID NO: 257465 - DNA, 503 bp, Homo sapiens
ctccacactgcctctcatggggggctgggatagagaggaagacaggtgtgcaggcctggtcctgttctgaggactctgctgaaccggatcctatgaggttattttgtaaactctaatatatgacttgtaaactggacatgaacaagaatttgtgatatagcctctttaccaggattgaagaagatagaaagaaaaaaatcttggacaaattaattgcaggaagaaatgatcaaattttggcttacatattttgcaacagtggtataacacaaagaagtaagcaaatatggcagaagtgtggtggctttggcgtctacttttgaccatagtggtggccctgttattcgtggctcccggggttcctacacatccttcccgatggaagaaggggttggccaaaaaggtcagccagctgatgggttggaccaagaaagacagagtgataagaatgagtgacaccatgttctatcattttgtattagatgcaccaaaaaactattctg

SEQ ID NO: 257466 - DNA, 159 bp, Homo sapiens
cttataatagctatgtactgctgctttaactgcctatcaattataggtagagagtaccctagactgaaatctactgagtgacctgacaggtctgaatgaaagcccagcactcctagacaaccaagggtctgttgtgtggccagaagggttgagtttgta

SEQ ID NO: 257467 - DNA, 419 bp, Homo sapiens
tgttgtgccagaaacagctcaatagccaccacatgcgtcctacaaaaggacttgcttaagcttttacagaaaattgatttctaaggccccttcaaggtccaaaatgcctcactttatttgacagctatcccgttatctcacttaccacctgctttctaacagggaggctgacattgttctgtaaagtggaggtgaagaaggatatttcaaacttcctgaaggaggtttccagcttcctgaggccatggatgcagaggctgcctgcttggtggtagaactcatcgcctgagaattgttttgactgtgacattatgaaaacattggtgcttcttaatgttttcacaatcactggattccaagcagtaaaattttcaccaagaatgtcacaatacctcctgccaacaaaagcccaaatagta

SEQ ID NO: 257468 - DNA, 249 bp, Homo sapiens
aacctctgtgcttggaggatcccccacttggcacttcgatgcttttgaaagctggaagtccttccttggtttccagtgctgttatactgtcttcacaaataaactataaactactaagcttaagggtgggtttctgcttcatgaatgagcacttgaacttggaattctaaaacaaggttttgagtcctggctcccttatctaatatctggttagcataggtaagtcacataccttccctgagcctccct

SEQ ID NO: 257469 - DNA, 423 bp, Homo sapiens
ggccaccggtcacccaggggtgccttctggctgggaggagcaaaacaccctttttcttctcaactgacaaaactcagtctctcattaacatatgaaaacagcagttcaatttctcacacaaatgcacacagaaaaactgaattaacattaaatttgagagaaaaagcaatagggaagagcctttagaatgcatctctgaactagaattaggttccttaacaacttcagacaggaacaaatagcaaaaacaaacacacacacaaaacagcaataggatcactgagcgctccaatggtaaggaggaattacgaccagttagttgttaatattaactttaaccaagacaaaccccagttcagttacttacctagggatgagtctcaggctgaagactggtttctaccagcaagaaagcaaaaaaaa

SEQ ID NO: 257470 - DNA, 252 bp, Homo sapiens
gaagttgcggtcagctgagatcacgccattgcactccagcctgggcaacaagagcaaaactctgtctcaaaaaaaaaaaaaaaatggaggaaagaaatgccttttagcaaggaaaagttaagaagaaagttggaggccgggcgcggtggctcacgcctgtaatcccagcactttgggagggcgaggcgggcagatcacgaggtcaggagattgagaccatcctgcctaacatggtgaaaccccatctctact

SEQ ID NO: 257471 - DNA, 1229 bp, Homo sapiens
  misc_feature (650)..(650): n is a, c, g, or t
  misc_feature (652)..(652): n is a, c, g, or t
  misc_feature (839)..(839): n is a, c, g, or t
  misc_feature (976)..(976): n is a, c, g, or t
ggagaagtcagcaccagcttaccctgggaaagtcaaggtgggcatcacagagaagtgatgtttaatttaggacctaaaggatagatgagatttgtcagacacattgaagagctcctgcctataggaagcatttgcatgcatttctctttttgcatgtcctacctgcttggtaaattttatagcctcaaagctttttccaaggacaaatatagagtcatttaatttaacatcaatatttttggaggacacattactatttaatagatgagtcaaaagcataatggtagatgatggatgctaggcttggaaatgcatcatctaaaggccaaactttgcttaagaaaaaaaaaacaataatgaataaagtaaaaatgtacatcttgataacaaatgcaagagtcagaatatttgtcctaattaggtaaagcatacaaaaatttcaacacagaattgtgattatttaaataggacagcaggaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcgttcaangncctatcacattttagtttcttgttacataagcactgcacctctagtaccaatgtggattagttatctactgatgcataataaactatcctaaaactcaaaactgaaaacaacaagaatttattgtttcacgtattttctgaaggtcaggaattgggagccatttagacggacggttttgactcagantttcttatgagtttgcaatcaagctgatggccaggcctgtaatacctgaaggcttgacaagggggaggatctgcttcaaagctcactcacatgtgtgtggccagcttccattttttattagctcttgccacatgagnctctctgcatacattgcctatcgtcacaacagctagctttccataggttagtgggccaagagaaacagcccaacacggaaacctctgtctttcaaaacctaatcttggaagtgacatatggtcgcgtctgtcatcatctatttgtcaggggcttgaatatgaggaggtagggactgttggaagagtgttggtggatggcaaccatatttcctatctggtggtctaatgcattggtagacatcaataactactt

SEQ ID NO: 257472 - DNA, 411 bp, Homo sapiens
tcaagggttggatcaaattttatttgcctctattttccaatacctagcagaacagaagcatatcccaacttgtccggtcaagggaatcatcctctggagtgcttttggtgaattacacaatatccaccagcctttatgagaagttattttgttggcagagggctgctctgacatcctgtgcacctgagaggcaaggaagaccacctgaaagagaagaaatatagatgccccagagagactgtcttttctacaggatttggaaaatgaaccacaaatccaaatacccccacagaggcagaatgctaaaaaccttcatctcagattgacacagtttagagatttgaaagcccacttctccttttaccatgtcaaattataacaggaaaaataaaatgctgatttgagtctcta

SEQ ID NO: 257473 - DNA, 220 bp, Homo sapiens
tgagtggggacattgatctcctgccgctgacacttatggttttcaggccttcagaccaggactggaatctacaccactggctcttcagctcccagactttcaaactttgtcaccagctttactgggtctccagcttgtacatgacagattgtgggacttctcagcctccacaattgcatgagttgatactttataataaatatctttatgtatatccatc

SEQ ID NO: 257474 - DNA, 380 bp, Homo sapiens
agctaccttctgctcattgggttccatactaatagtggtgtcaaagtaattaacagtgtgatgttttgtggactggtgagatggccaaagtccatgtgagctaggctaggggtcagcaaactacagcctggaagtcaaatctgacctgcaccccatttttgtaaatcttgcaagctaagagtggtttttgttttgtgaagttgaaaaaaaaaagaaagaagaagaagaatatggaacagagaccatttgtggcctgcaaagcctagaatatttactatttggccctttacaggaaaagtttgccaatccctacactaaattgtcatatagagccagagagttgatgtagcccttagtccattactgttcctgccagttga

SEQ ID NO: 257475 - DNA, 344 bp, Homo sapiens
cacacccaaagccaggaaaagtgactccctcctctatgtcctttaaaagtgaggcaaacagccaggcgcggtggctcacgcctataatcccagcactttgggaggccgaggccagtggattgcctgagctcaggagttcgagaccagcctgggcaacacggtgaaaccacatctctactaaaatgcaacaaaaattagccgggcatggcagggtgcgcctgtagccccagctactcaggaggccgagacaggagaatcgcttgaacctgggaggtggaggttgcagtgagccaagatcgcaccactgcactccagcctgggtgacagagagtgactctgtctca

SEQ ID NO: 257476 - DNA, 3627 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttga

SEQ ID NO: 257477 - DNA, 2181 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaa

SEQ ID NO: 257478 - DNA, 1820 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaaatggacggagggagcgaggcgttcagttggggataatgaattttggggaggggaagggatttcgtgtggatc

SEQ ID NO: 257479 - DNA, 1591 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagcattctaagcgcttcaccttgtgagcctggagaacttgaccccctgggacctttcaggtggtactggg

SEQ ID NO: 257480 - DNA, 555 bp, Homo sapiens
cgcacgctcagcgagttccagaggcgccagtggaagctgcggcggcggtgtctcgcgttcggcgggatttctcttcgctccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaa

SEQ ID NO: 257481 - DNA, 3674 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttgaaatagttttcttcgtgtttttttcttctgctatgacgtcatgcagca

SEQ ID NO: 257482 - DNA, 3631 bp, Homo sapiens
  misc_feature (3588)..(3590): n is a, c, g, or t
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatagggggcgctaaatacaaaagaatcccacccnnnggggtggtatgtactggtgcgggctcgactccgttttgaat

SEQ ID NO: 257483 - DNA, 3620 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagatcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttgaaatagttttcttcgtgtttttttcttctgctatgacgtcatgcagca

SEQ ID NO: 257484 - DNA, 3620 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaacatagtttcagtgtgatttctagagctaattcaaaatagtattgatatattttatgtgactgcatttttggggaggggtaccgaaatcgttaaatttgtcagtttgcaaaaatatcaatctttaatgggagaattttcaatttgccaattttttccttgaatgggtttaagtatgctacaatatacagttcaggcaaaatttaagatgtaattatcttcaatacttaagtgtgcttgctttctagtgccttggttttctttcttgatgctggaaaaataaacaaaccggtattgagtgtttaggcgagtggaaagtggctacaatccaaaattttaaatttaactctgcctcggccattcaaaagtctaataacaaaaaatgtaaacctaatttggcagtttgttaggttagacaactgacagcctcatttcattcctacaagttggttttcagtaatctcttccttccccccagtaaggctggaagaggctcttggcaaacttcttagtgcaagcaatggttagattaatttgtgaggcagctctttaagacgttcagaggtaagaaatactggatttataaagcaaatggctgtttgggggattccaaggatttacctaattgtccaattctacgtgctctctataccaaaacaaaaaaaaaaagctatccacctttccatgtgggtcaaactaaaattagaaatgtcccctcactgcagatcaaatgtaaagcttccagttaaggagctaaatgaggtcctcagctgaatgaggaaccctgtacatccccttgcacagccctattctaaatcgcttaaactatgctgatagctgcttaggttcttgagtagttctgctcttaaacgtagggaggccctgagaactaaattttgccccaaaataaaaacagaaattatgagattgcctcctgtcattttggttaacccagtccttcacctgccctgtgtcagtgtcttctgagggcaattgcgttgctcaaatcactagcacagaggttccttaatttggggccttagaaaccattgtgggccttggggtccatgaaccccatgaaattatttgtagacttgtatgtacatttttctggggagaaggttcaagagattcataagattgtcaaactccttgaaggttcagaacctctgcagggaagggggaagaaaaccctcccattaggaagcatgcttttgcagttaaatggcgatggtggaggtgatagggacttcaagagtaaaatgcaccttgtattgcataagaagcatacacaaatcaataaatcaagggagattataccagtaggactgaatcagggccttcaaagctggactgagttggtcctgttctggcacatatggtccactggagacaatgtatgattgagtttttctttggtctaaaaattatattaaacatttattttgaaatagttttcttcgtgtttttttcttctgctatgacgtcatgcagca

SEQ ID NO: 257485 - DNA, 2709 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtgcctctcgcgcatggaggacgagaacaaccggctgcggctggagagcaagcggctgggtggcgacgacgcgcgtgtgcgggagctggagctggagctggaccggctgcgcgccgagaacctccagctgctgaccgagaacgaactgcaccggcagcaggagcgagcgccgctttccaagtttggagactagactgaaacttttttgggggagggggcaaaggggactttttacagtgatggaatgtaacattatatacatgtgtatataagacagtggacctttttatgacacataatcagaagagaaatccccctggctttggttggtttcgtaaatttagctatatgtagcttgcgtgctttctcctgttcttttaattatgtgaaactgaagagttgcttttcttgttttcctttttagaagtttttttccttaatgtgaaagtaatttgaccaagttataatgcatttttgtttttaacaaatcccctccttaaacggagctataaggtggccaaatctgagaacaattaaattcattttagttataataaatttaatatttgtaaatgtaaaaaaaaaaaaaaaaaaaaaaaaaaaaaaaaaaaaaaaaaaaaaaaagggggggcaataaaaaattttcaaaggggggcaaaatagggtcgttttgtgaaaacggggcttcccctattatggtgggaagctctgtttatattatacgccttagcgagcgcaggaccagcatgcgtcgttcatcaacacaacgtactgcagtacttgggacaaacctgcgttgacgcacgcggatgttacattactgttgaaaaaagacaccccctacactcacctagcggcggggtcggcatccctattgttggcggaaacacatcacttcctaggaaaatatttctaacgccctccacgggtacaaatctaaacaccttatcaggtgccttagttgggtgtcctacctcccgcgcattactctgtactgctcattagaacaactatgtcctaacaagacgtattaattcaggaaactttttaccgcgggcgtatcatgatcatctctactacctctgacttatctctgataagctgtc

SEQ ID NO: 257486 - DNA, 1649 bp, Homo sapiens
agcagttggaagttggcaggtggagaggcaggttgggagggaaagtcgggggaggacgcggaagaggagctgtgggaagggggaggagggagggaggaaaagaggaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcagaacatgagcaagcaggagctcatcaaggagtacctggaactggagaagtggtcgagcggccgcgaatttagtagtagtagtagtagtagtagc

SEQ ID NO: 257487 - DNA, 667 bp, Homo sapiens
aattataatatgataccgaggcccaaagtcctaaacgtggaaactgaaaggagagcccccttaactcatcttcatttgaacctcaacaacaaaaaattaaaaaggaaaaacagttgctcccttcttaagtactgccttttaaaatgttcttgttgcacactgcttcaacttttctctgcccaccaggcttccatttgtgatctgtctgaaataactatttttgcataacacattctttcttcgctgctgatcttccctggagctgctgctgcttcccgtggggaatacagatgaggctggtgatgcaccaggagcaggccaggggactctgagatgatgactctttgtcattgtgaataattctctctgaattctcgggtttctggtgggtttttcttctttcttttcatcttcttggtataaatctagttttaattatttcacagaatatttgtctttctgaaagcttctcgtgcaaaacaaagacaaaacattaacatagtaaagttattttatcagtagcctttctctgtgttaattaggatgtatatcaatatgacatcattattttcattatttaaatgtactaaagtttaaatacttgtagcttttagacatgaattaaaaatagaactattttgaaactggtcatgaagactgagaggtt

SEQ ID NO: 257488 - DNA, 449 bp, Homo sapiens
gttctttctgctgatcctgccctcccgtgggaacttactgccttgtgctacaagctgcccttcctgccagctggtctgcagggctctttgctgcttgtctgacctccctccaagagctgccacagctcccagctcaggcagctgagcctctattccaagagggtggacactccaggtcctaccgctctgggatgagctggccactctggcatgcttctatccagggactggatagctgtgtggccacagctgtgcttgggtaaatggacaccaattaaaggattactggcaatgagaagtcagtcctgattctcatttgattggaaagggaatttgggactcaatgatagagctgccacagccacgtgtcttccccaatccacctgctctgattccatccaggactgccacaaatctaggcatgtcccaaaataaagcaatcattagat

SEQ ID NO: 257489 - DNA, 476 bp, Homo sapiens
aaatgttacttggtggtgtgccaatatcttttgcttgtttaagtcctagttaaagagattgccctaaaagatgtcaaagaattgtcaagattcagttattgcaaatccactccttataggatcattaaaagtggtttggaaaagcatttgctgatccattttgaactgtagctgttattcttgaggatttcatctgtcttggggtggataatgaacaaatgtcaatggagattagaaactagcaaacggaatattagaagctttcaaagattacaaatgggacattgagcagtaaacctagaaatagaacaaagaaagaaaagaaatgccatctgaaaagacacatatacactcagaattcacagtaaagggaattatgagattttgtaggacacttcatatttcatttttcaaaaatgtttaatggctcaaaaatgaattttcacccaggaataatgttctgatatattcatagt

SEQ ID NO: 257490 - DNA, 423 bp, Homo sapiens
agagataatactaatctattaagataataatttggcagaaaggtttaatcaagagagtggagcataaactgtatcgtggatgttatgtgggatctgaatggatggttgggggtcaaagcaaggcacacgagatgaaacaaacagcatacaactgtagggttagaaatgagtaggaatagtcatttcaacctatgaggtagaaccctgataactccgagtgtggatctcattccagcagtatcagcaacacctgggagcttgttagaactgcacatagggtgagaggaaggagaggatcagaaaaaatagtgaataggtactaggcttaatgcttgggtgatgaaataatctgtacaacaaaccctcatgacacaagtttacttatgtaacaaatctgcacatgtacctgtgagcttaaaagtt

SEQ ID NO: 257491 - DNA, 774 bp, Homo sapiens
agccagggtctcacttgactagagtgcagtggtgcaatctcagctcactgcggctcccacctcctgggctcaagcaatcctcctgcctcagcctcccaagtaacctggactccacacgtgtcccatcatgcctggctaattttttttatttttttgtagagatggaggtctctacagtctggtcttaaattcctgggctcaagcaatcctcccacctcccaaagtgctaggattacaggcatgtgccacagtgcctagtttgttattttttaacgtactatgttattgccacttcattattcaatttcacaaacctaatatcaatggaatgttactccttttgaatgataatcttgggcacctggaccactcccttttatttctggctgccaaatacccctgctggttttccagcttgcccctgttttgtcccattatccttgtttagtgaggttaataaataatgtttgtgaaaatccagtcagaggagcctttcctcagatgctgtttcccttacttttagtcccccttccctggtctctttgctttttacccacctgctctgccctgtcctcaagaggcagaaatactgcctcaaaacctggtctctgagaccctggctaatgtgaactggattctcctttcaccttcaatgtcagtgtcataacaggctccatttgcctgtcagtatagtcttttatctgttttagcacttttcacagccaagtcactcctcctgtctgcttcccagcctctcagaaaaaaaaaaaaaaa

SEQ ID NO: 257492 - DNA, 485 bp, Homo sapiens
aatgaaagggagaggggaaggtatatgtgtggtgtttggggtgggggttagttttagacaggcaggcaaggctgcctccctgggccgggggtgagacgtgagttggggagcacagcaggtgcttttgcagaagagagctccagggagagggaacagcaagcgcagagcctcaagcaggagcttctgcagcagcagagggagggaggtgtggcagggtagtggctgaccctcagtgtccttgtggcccttggaaggtctgtggagggggtatgacaagagtggtattcctttcattttaagggcccctctggttatggtgtcaagacacagagagatagagctgcagggcaagggcaggagtgaggggaccagttaggaggctgccaccatccgccagggacgcactgatgtggctcagagcagggtggcaggggtggcatctgctgagactcctgagatccaactgaaagagacaacaagtttta

SEQ ID NO: 257493 - DNA, 411 bp, Homo sapiens
cgagaagactgacgctcccacgcaaggatcgtttctgcccggctgtgccacctggggctccaggcctggctttgctctctggcttccccaccattggctacctggcctcgggcaggcccggcccagctctgcgactcagtgcctgggagaatgaagatgatcctttgagggtcctaagtatggggagggctgcgcaaagccatgactcagcacgtgggagatgagcgctctgcagatgcacacctgccctggggggagccgccagctggggcctgtggcaggaggcaggaagaaggaaccttgcacaggaagggcccaaccagggtctgcaggggccaggtctgctgtctcctgaggacagggcagagactgcgtgtggctgctggcgtggagtccgttccccaggaggtg

SEQ ID NO: 257494 - DNA, 460 bp, Homo sapiens
gaagtccccttcacaagcttcgcagctctgtgcagtagcagccctttaatagctgtaacttcaccactgggaaaggaaaggaaaggaaagcctctctgctttcatgctgattgctatggaagcttgcccaagatacttccccttgcatgtgcagggctgtgtgcaaaacagagaaattgctttccacttaaaagcgttggcctgttattactctatgaacctttgaggaaatcagattcagaggtttcctaaatatagaaagttcctttctctcttgttattaaagccacaaacaatctaggggtaattttttatattattttgaggttgcattaaaattaagaggaaggacagtactgcagagatgcctggttgtttgttgggtttcttaaaaggactaaatatgaataaattacgaattcttgcacgttaggaaagggaccttttgttgttgttgttg

SEQ ID NO: 257495 - DNA, 527 bp, Homo sapiens
gactagctgaagatttccagtgcagcagcctgtggacagagaccacaggcactgaagcttagagcggccaaagtcatcaacatttttctttaagaaaatgatctgcatcctataaagatacctatgatggtcgtaaagtttactctctaagtgcatcagcagagtaatgaaggctgggtttcataacaataaaaataagttatgtcttgcacctgatttttttcccccaaggattgttaaattgacaaaagttttaagatctatgacttctttatgcgcctttgtttttactaaggcagatgtccttgatcaaaaattaattagttataatataaatcagtggttctgcataattgcaaataaaatgcagtatggaaggctatctttttctttgactaacattcagataagctttcaaatttggcataacgtttcctggccaggcatttttgaggacagatgctatttggcagccatcaacatgctacatcaagcgtctttcaagtcctttgtgagctctttggtgc

SEQ ID NO: 257496 - DNA, 270 bp, Homo sapiens
gaagacagaaataaaactaaaagctaattctctctggacttggaaaggaaggagtatcagagaagcagagaagagaaaaaagcttagaaagcaggaaagaagctgaaagcatttggaagacatcgtgaactctttgaaggcagaaactaaatgaaattcaccttcatatttacagggaccagcacagcctctagaacagaatgggtgctcaaatcaatatttctttaaaagaataaatgaatgaataaataaatgaatgcaagtggaaga

SEQ ID NO: 257497 - DNA, 395 bp, Homo sapiens
atgcaaacaccagaagctgggaagaataggggagagaaagaggttggttaataggtacaaacatacagttataaaaaaaaataggtactagtgttcgatagcacagcagggtgactgtagttaacaacaatttatcctattttcaaaacagctagaagatttgaaatgttcccaaagtaagacattataaatatttgaggtgatagatatcctaaataccctgctttggttattatacatcgtacgcatgtatcaaaatatcacatgtaccccataaatatgtataattattatgagcaataaaaaagctttaaaacagaaaatgcaatctaattaattttttgttctcagacaagaaataattgagtccaaaatatttttctgaattgctatta

SEQ ID NO: 257498 - DNA, 416 bp, Homo sapiens
cagcactgttatggtgttccagttgccattctaacccaaattaggtctttacctcagtcagtaagctagctggccatgtcaggattggtgaagttcaaaaattagtcttcataatgttaaaagccacaattcatcatgaacataagacagctattgatacctacctatgtatcaagttacacatctgcaattttttttttttgatggagtcttgctctgttgcccaggctggagtgcaatggtgcaatctctgctccctgcaaactctgcctcccagattcaagcaattctcctgcctccacctcccaagtagctggaactacaggcgcatgtcaccacgcctggctaattttttgtatttttagtggagacggggtttcaccgtgttagccacgatggtctcagtctcctgacct

SEQ ID NO: 257499 - DNA, 483 bp, Homo sapiens
atgattgaagataaggttttgaaaagatctaccagacacatactaaatcaacttctgtagttatattaatgatttcaacaaaatataagtaagttaaagggaaaaaattaatagggttaaccagagatattacttaataataaaaggaaaacactataaaaatatagaaaaattatgaagctatgtaaatctatcaacataacctcaaatatacaaaacaaaaatttataaaattataagaataaatctacagaatggaaaatttcaatatacttgtcccacaaatgaatattaaatacagacaaaaatgagtgataatatagaatatttcaacttcaaattgtacaagagtaattgaatatacagataaatgtatattctgtataaacatatataatctgtatgaatctataatacatctatatctatttctacatgaatacatggataattgttaaccaaaatacgagcacctatgccact

SEQ ID NO: 257500 - DNA, 200 bp, Homo sapiens
gatccggctggaggcagaccggttgacatgaattgctgcccagtcttagtgaccccctgaaatgccaacatgatctcccctatcaagccaagcccctgctagaaaaggacatctctaaaatgtgttagcacactgcagtttcattttaaatgtgtctcataatcaccagtgattactactaaggagcttctctagagatc

SEQ ID NO: 257501 - DNA, 413 bp, Homo sapiens
gaggaggaaaatcagacctagagatgtctggttgtgtcctttggagttagagggccctggatttgaattctgaccctgcctttgtattttatctgcgtctccttgggttgagttggcttctcctttgagtctccggttcttctgtaaaaatgagaagaatctattagagtaggcttgattagaaacctgtgtattagctaacaagaagagaaatgccattccagaagcctttttaggctggagtctgtgctgttcacagaaggtctgatcagaagttggctgagacttggaggctccagttggatttctcaacttctgaagtcccgtctctgagcactgtgaggcctccccaccctcacccacacacccacccccgctctgtgcagtcacagagcctctcctgacagcctcca

SEQ ID NO: 257502 - DNA, 648 bp, Homo sapiens
gagtgcggaggcaccttgtacatgttacctgacatgcacacttttggattagtacaacaaagaaagaaagatgtataagaattcagtccatgaagggataattcagaaattgccatccacatagaatactttggcatcttaataaaaacaaaagttctgatttcaaatttttagctcaaatagatttttaacctctaaattataactttcaacaggctccacaggtaaatctgtagccttgaatttcatttaaataaaaagccacagaaaattagtgacctctacccaaaataagacaattctctcatgtatgaatttaggtttcttgaattcactaagtcagcacacttaagcagactaccaatccaacgtaggattttctttcttaaatagtttttctacttctaattccacaatgatataaattctttcattaatctgatttgcaataattttaaataattaatgctaactagcagtaaaaattcaagtatttcttcacggaagaaagaatatgggaaagcacaaacagcaattttccccagcaaactgtcccatcaatactcctgaatttttctgacacttctttagaaataaagctccccagccgggcgtggtggctcacacctgtgttcccagcactgtggg

SEQ ID NO: 257503 - DNA, 435 bp, Homo sapiens
aggttcaggcgattctcccacctcagcctcccaagtagctgggattacagttctggaggtcgggaagtccaagagcatgctgctggcatttgtcaaaggccttcctgctgtgtcatcccgtggtggaaggcagaagggccagagagggtgatggcaagctcaattcacatccatcacaagcccactctggcaacagtgaatccactccctcaataataacattaatcctttcatgaaggcaggtccctcatggcctaatcacctctaaatggtcccacctctcaatactgttttatggaattgtgtccaacacttgaattttgggggacacattcaaactatagcgatcatgaaaaatcttttttattatctcaaatgtcaccaaaatctctaggcttttcctttatagtcaataaaagtgtaattaaatacatg

SEQ ID NO: 257504 - DNA, 481 bp, Homo sapiens
gcacttctttttaaaagaatagggatagtgtgttacctctaagatccaagtgcacccttctagatgcattctgtgataatcatttctctgaagaacgtgtgctgtgaagttttctcagtagagcactgggaggaagaggctgtcctaagtgtccagcatgggagatggcaatgtgggtgtgaggaccatcgacactgtggcccagcgacagcctagaacgtggtctttctgtgaccttgcagactcagcctatcctaacgttttgggagctcagctgacatggccactaaagcctccacatggctcttgtgttctaaaggcctcctggcccagccagggcccacaccctgctacccaccggatggccagtaacccactggatggcctgctctctgccagcactccagaaggtaaacgacggcttgcccagagactttggatcagctccagtcttgtcaaaccagcaaactcctctgtgatt

SEQ ID NO: 257505 - DNA, 412 bp, Homo sapiens
actgttgggaaggcatgatgtgttttgaaatgtgagaaggacatgagatttgggaggggccaagggcagactgataacgtttggctctgtgtccccccccccatccaattctcatctcgagttgtgatccttagtgttggaggagagacctgtgggaggtgactggatcatggggtggatttcccctatgttcatctcatgatagtgaataagttctcatgaaatctggttgttaaaaatgcatgtggcacttcccccctgctacctctctctctcctcctccaccatgagacgatgtgccttgattcccctttgccttctgcgatgattgtaagtttcccaaggcctccaagtcttgcttctggttaagcttgcagaactgtgagtcaattaaaccttttttcttcataaa

SEQ ID NO: 257506 - DNA, 681 bp, Homo sapiens
tgtaaaattgtctcctaatcgagttatctgatcaggctatagagaaggaaatctttctgttccttaactacattgtagggaatatcatgtttatttaatcaattctttgtgatggatgtttgtttccagttttcactattataaataatatgtggcaaatagcattgttcatgcatcttttgatatttgtgagattatttctttgcacaagagccaaaatgatagaattgtgcagttaaaatgtgtacaaatgaacatgtaacagatgctaacagggagtcctcaaagaggcttgtatcagtttatgctgtttcctcacatccactccaacaccagatagcaagcatttttggtaaccgatttatagaaatgcttaaggttaaacatcaaatggtgcaccataaatttcttttaaaaaaagaaaaacacaatgcttaaagaattactattcatgttttaatggaaagaaagtggtccaaacatatattcattcaacagacacttattgaaaacctgctgtgtgacaggcatcattgtagatgctggcataataacaaggaataaaagagataaaaatcctcactttggcatagtcaattgttaagaaacaatgggatacttaggccgggcgcagtggctcacgcctataatcccagcactttgggaggcttaggcgggcag

SEQ ID NO: 257507 - DNA, 651 bp, Homo sapiens
ttctttgatgtagaaatttcatttaactactggataagagggaaatcctaataaatagcatttgattggggaactcttcctcttttctactgtcttcctttctgtttctcctgtccctctgtatcctgctggttttcaaatgatattgcatatttttaaattccttgtgtaattccaagagtttctcagacatttggcatcattgcaatgtgatcttagttatataaaagctgcctttcagaggacagctatctagtttcagatgggttgctgaaggtgtcctcaaggtatcctctcacctggttttgctctgctggtttggttccagtccattgctgggcactgtactgggtgctgcaggggtacagagaggaggtagatgcagtcctgccctcaagaggcttccagtttagagagaaggcaagtgccttcattcacagagtgtttgcactggaagaaattgtagagataatctggtccaatcctttcatattaaaaggtgaaagagaaacccagagttagtttattacaccagatcagagaacttggcgacagagcagacattagatctcacctctccgggccctctgtctagtctgctgtatcacaggtgattatttccaaacaaaaatgttgttttcttaataagta

SEQ ID NO: 257508 - DNA, 484 bp, Homo sapiens
ctattgtctgacattctcatataatgaatcctgggaaactgaagtattaattttaaaaattttctgagaaaatatgaaaaagaaaaaaaacagtaaatatatgatgggatccttttcccagtaagtagaaaatctttggcgttattattgcctcattataaaatgtatctattttgtgattagcaaatcccatgaaaatagtgattctacttgaaaattcttgataaatactgacctattcttataatccacatattttttggatccattatcctcatgctaaataatttaaaatgtaaatgaatgattttattctttgtttatagatttttaaacttcatcttcttggggctaaatcctacctatcttttattagactctgagtagacatagaaaaatcatgtctcactgggtgcggtggctcacgccggcaattccagcactttgggaggctgaggtgggcggatcacctgaggttgggagt

SEQ ID NO: 257509 - DNA, 432 bp, Homo sapiens
tcaattttagagttatctttaaggatttcatgtttctgatactgcagtttggaggccaaaccattctcttttctatgcaatcccatatggagtccataaagtagaccagcaaggagaattatttgtggtaggctggtcttaatggacaaaatgcatttattcatgtgaacattcctgtctcaccttttcatctgctctgcaatttttgtgtgcttttgccagctgaggcattgctgcttacattttttcacattcacgtttgtgttatatcctgcggcagctggcctggtcctaactacttcaaattgtcagtggctgatcatagccttcgaatgccttgttagatagtggtattcctaaatcctattacctgaaggagaactgtttatgaaaggaacagagtacagaaataaatggaatttgatatgattc

SEQ ID NO: 257510 - DNA, 697 bp, Homo sapiens
gtactttctggtgcatctttttggtattttattgttcatccttttattttaaaataaaaacattgtcatttgggtgttttgcttttaagcagcagcatgtagctggtgttgcatttgctgtcaaaccaagtggtgttaacttttaatagtgactttacttaataacagataaatttcatgagacttgctcaggggttgactgaggcagatgagtaggtgttttactacagcaataggaaagaaggaaggtcagggcaaaggaagtaaagcatctgtattagtcaccttgggccgccatgacaaaatactgtggactagctggcttaaacaacagaaattcatttagttatagttctggaagccagaagttcaagatcaagttgtcagcaggtttggttgctctgagtcctcactcctgaacttacagatggccaccttccccctgtgtcttcacatggccctttctcaatgctcacacatctttgtcgtctcttcctcttcttaaaaggacaccagccccattggattagggcccacccttacgaccttatttaaccttaattacctctttaaaggccctgtctcctacagtcacattagggattacagcttcaacataagaatttgggggaaacacaactcagtccataacagcatccttgtgagagcaccatagtgatttcatagactctccgcc

SEQ ID NO: 257511 - DNA, 342 bp, Homo sapiens
aatttgtacacaattcttcacatatgtaccaaaaatctaaaaagccatgtattgcaaattctttgtgaagttactctagtgactttccagcttaatatccggaggcaaaatttccttaagaggctatcacgtaccaatatcttcacatgttgataagctgttaaatacgtcctaccaattcataactgaatagcatgtacactacatactcaaattttcattcacagcacattcacaaagttattggaaaacaggactatcacaactaaatatgttacagagtgcacacaattcagacagggaaatccacgaatatggagtggttttctttaggaaacaatt

SEQ ID NO: 257512 - DNA, 478 bp, Homo sapiens
tgaatgaagtgtagccatgaacttaatcacgaaacacccccttattggtgagaggcagtgtggcatagtgcctgggcactgacacttgctttgaacgtagcagccgtgagatcctgggcaggtcacttaagctcttggtgcctctgatcttctgtgaatgaggatgatgggtttactgagaggatgaatgagtcggtgggcgagaggtgctcaggctgctgcctggcacgcagcagcaggtgaagccctggtgatcgtgtgtgccagtgtctgctctttttttttttttttttttttttgttccctggggaatagaagccactgtgactggattggattacactgtggctgtgagagttttcatctctgaccatcagagcagacctgcaaggcaggcagccatagccttgacttcctcagagggcaacgcaggtaggcagagctagggatccaaatccccatcatgcagagagccagg

SEQ ID NO: 257513 - DNA, 478 bp, Homo sapiens
tacatcttgaatctccggtatcaccttccaaagactgtcctggacaagagctggctgaggcctcctggcatcttggaaaatgcatcagatctgctcaggaaaatgtgcgtgaggaacctggtgcagaagtactgccgcgggatcacagctgagcggaaagcaatgatgcagcaaaaggtagttacaagtgaaatcttcaggggaaggaaagacggctacacagaaagtttaaatcaaccctttgtcaacagtcggatagatgaaggagacattaatccgaaagtgcttcagctaattagccatgagaaaatccagaagccactgtgactggattggattacactgtggctgtgagagttttcatctctgaccatcagagcagacctgcaaggcaggcagccatagccttgacttcctcagagggcaacgcaggtaggcagagctagggatccaaatccccatcatgcagagagccagg

SEQ ID NO: 257514 - DNA, 301 bp, Homo sapiens
ctttgattaaaaaataaactggtttgggtttttatatctttaaaatcctttcatttttatcatgtgacatcagtttcatatgggagtgaaatccatcgtatttacagttctgcctacacttatgaggagggaattatatagaacttgtacccccagggaatcttgtgggctatcttgggttttggtcaagcacagaaggcaggagtggatgtagagagatgagttcggaggctgcggtagtgagaatgatatttgctttgcagaatggtgacatattgatagggagaaatgtatggattta

SEQ ID NO: 257515 - DNA, 336 bp, Homo sapiens
tcaccagtgcatgctttggtttagaggctaccaaactgtcgtcttcatccagagaatgatttttataaaaaagatgttggaaaattacagccactgaatagaacatatggaagtccatgagagaaagagtggagtattttaggcaggatggatgaggtctgctttgactccaaaaataatctcaattcaaactgatataagaaaacatttaaagttgatggtgtcccacaaaccttagattcttctgggaaattaaatttttctaggtagctcattaatctgagtctagataacattggcatatgaaaagtcttgagactgttgaaagggttcaaa

SEQ ID NO: 257516 - DNA, 464 bp, Homo sapiens
tagttccattaacaaatgatgtgatgcagtctatgttgcaagttggactaccatttatccaagacgacgaattgtgctctggaatgcagaatacagcactgggagttggcctcaggacttcaagatttgctgcaggcattcagaagagttatttaaattctctggacttcagttttctcacctacaaatacaaacaaaggtaaaataatctctaagtttccttcaagctctaatattcggcaattttataagtagacctgtgtgtgtgttatgggaattacaaaaataatcccagtgctcttctaagtaaataatgtagctttctttataaagtgttatcaagaagttacacaaataaactgttgacccttaaataatttttttcatttgaaaattgatatatttgtagtattgccatgtgacaacatataataaaaattgtttccagtttgtttttcctgtgt

SEQ ID NO: 257517 - DNA, 286 bp, Homo sapiens
taaaactgtctgtaaccatgagctaagtatacaaattcagagttagcatttaacaacttctataacaatttgacattgtaacatctcagcacatggttatttttctagtaattcacttttattgtatttgacaaaaatgttattctgcagtggattggagataaaaattctggttctttatcgcagctagtttgagagggagaaaagggctaaaaatgcattgggaaggtactccaagtataaagatttcttgatgtttcccatagatattgaagtatgacagctg

SEQ ID NO: 257518 - DNA, 397 bp, Homo sapiens
ctgctgacagtctcatcagatgttgtgagtgatccaaatgctttatgatagctctccttggtgctcctgtttcctttgaatggaattcctacagaagaaaaagggaagcaaatatccctctcttttcccaggctctaacactcttcttgggtcctcagtgtagcaccgtgggagaagttcttgccctttcagctcagaagactcattttgaagccaaaacatgatgatagatgcaccactggcatttgctgatcaagaaaactcatgtctgcctggtatggtggcttgtatctgcagttccagctattttgggaggctgaggcgaggggattgtttgagttcagagtttgagatcagcctgagcaacacagtgaaaccccatctctttaaaaaaaaa

SEQ ID NO: 257519 - DNA, 417 bp, Homo sapiens
gatgtggagctgcttcttaggggtgcgcagagaaagtggtctcttgagatggaatctactcctggtgaaaaggctatgaacactgttgaaatattggcaaagaatttagaatattacataaacttagctgacagtgcaacagcagggtttgaaaggattgattccaatttccaaagaagttctactctgggtataatgctatcagtgtcacatgctgcagggaagtcttttgtaacaaggggagtggtggcaaatttcttgttgtcttactttaagaaattgccccagccaggccaggcgtagtggctcatgcctgtaatcccagaacgtttggaggctgaggcgggtggatcataaggtcagagttcacaaccagcctggccaacatagtgaaaccctgtctctactagaaaaaaa

SEQ ID NO: 257520 - DNA, 569 bp, Homo sapiens
cctagatttggctcagtctggagagaactggttttgagaatcagtgaaggctgcaaaagtgtaatttggaaattatttcagttcggaggtgagccctgtcttatctttggacagtagttagtaactggcgcaccaggagttgtggagtggctgggcctgggctttcatcttggcccagcctcttgttagcagcccttcaagtgactggagctttacggagaacatgctgcaacctggctttgctcagcctgccgccagtgtgggcaaacctcttcgctggcagggcccggggcacggcgctaggtctcaccacccctctccccagccaacggctttctcccagcctcccaagacagcctctcacccggccaggcaggcaccccggcgaatctgatccctggcctagctcagctcacaacacgggtgtctccgagccccacagcagccatttccccgtgtttaccctcctcggtcctctgaccacccccttcaccctcagctgatgaccacctcccgcttcgcagtggaactaatagcgtctccagctctccagccccgatcctcccttc

SEQ ID NO: 257521 - DNA, 703 bp, Homo sapiens
gaaagagacgattgaaaatggcaaagtgatgtgttcttgtatcaagatattttttctactttaagaaaccgtactcctcattattgatatggttttattcaacatgattgtcagtagaaagagttttttactggaaaatatataatggcatatacatgactaatggactgatagttggtagaaagtgtacttcaatagttttaaatcccattttgaatttagttctggaaaattaatacagacagtccctgactaattaaggggggaagaaatctttaaaatggcattaagaaaaaatacatttttactatttgtaggaattttctgttattttcaaaatgtaacttgcaaaattagactggaatattcacaagggagggcacattctcaaaaattatatatggagatgcttaatggacagaataacagcaaagaaagaataataaatggagatttcttagaactctaggatgactaatttaggccatttgaacgtgggcttatccaaggaatacaccactatttctgattatgactttgatagctgagaattattttccatttcaagtataaaagtgaatgctttaataaaataaaagaaaacaaagattaacatggttctagaatatgaaaaaaataatcgtttttgccttttttcagttattaaaattgattgctttgtggttgctttccacaaaaagcc

SEQ ID NO: 257522 - DNA, 556 bp, Homo sapiens
cagttgtttttgtcctgccactatgaatgaattatttgtgtcctctggcttctgttcatgcaattgagaagtcagtgtccatctgattgtccttcctttgtgtgtaatctgtcttttgtctagttgatcttttttaataaaggtaaaatttatatagtgtaatgtacaaatagtaagtgtgcagttcattgagttttgatgaacatacactaatccaccccatcaagatacaagaacattctattagcatagaaggttacatctatttccaggcatttcctctcccattccacaataggaaaccagatttctatcaacatagattagttttccttgctcttgaacttgatacaaatggaatcatgcaaatggactcttttgtgtgtggctttcttcactgagcataatgtcaatgaaattcatccatgttgttgtgtttatgagtacttcgtagacttttatccctgagtactactattcctttgtatgaagagaccatagacatttgagttctttgagactacaataaataaagctgctataaatattcatgtat

SEQ ID NO: 257523 - DNA, 432 bp, Homo sapiens
tcgaactcctgacctcaagtgatccacccgccttgggctcccaaagtgttgggattacaggcgtgagccacagcgcccggcctacgtcatcatttttaatgactgtatagtatttcttcacgtgttacaccgtaattgattcaaacaatcaaaattatatgtagatgaagtaatgtatgtatgagaatttagggcttggactaaggtgacacaagtgaacattgcagggtgtgacctaaagagagagcacctcttaaattccataccatgggctccttgctagctctaccctggtcctatccctgcaaggatggttatctagtagtatttataatcatttaaaaaattagtgtcatttgacttgttttcagttttgaccctattgtaaaccaaattgcagttaaaagccttgtgcaattattttattattat

SEQ ID NO: 257524 - DNA, 246 bp, Homo sapiens
gtggccggatcagtgtctatttgccgttgcagaggcaggatccatgaactcatctctggattggatgaagatggttgcagttgactcattttttggtctatattggctgggtagtgacaagactcacatttagttattcttttctgcagtggagctgtctgttagacacttgggatcctcatgtgtttcagccctgagcccctgttgaagctttaccaataaataatcctttagccaggacgatgg

SEQ ID NO: 257525 - DNA, 380 bp, Homo sapiens
gcagctgctgcttttacatcaattgtagcaccagcctcattccatttctcccaccttccaggacaattaagacattcaaccacagaattactcccatttccagacagcactccatctgagcatggcctgtgtatcagtcagggttctctaaacggacagaactaataggatagatgtatatatgaaggtgagtttatcaggagaattggctcacatgatcacaaggggaagtctcacaataggccgactgcaagctgaggagccaagaagccagtctgagtcccaaacttcaaaggtagggaggctcacagtgcagccttcagtctgcggctagaggcctgggagcccctggcaaaccaatggtgtaagtccaagagtcc

SEQ ID NO: 257526 - DNA, 329 bp, Homo sapiens
gcaagttggcatagctccctaagccttaagggtgagctgtacatcatgacttctttctaagggtgcagagtacagtttggaggagaggggagtaactttacagtggagaaacctgacaaacatttcttcagccaggtgatcaagtccaacatgaaaataaggcatgttgatataggtacctttgattgatgtgataggatggaaatggcactttatctctgtggtcttcaatcacgagaaaaacatcaaataaattccactggaggagcatcctacagtataccttactgctattcctcaaaactgtcaagatcatcaaaggtaaggta

SEQ ID NO: 257527 - DNA, 559 bp, Homo sapiens
gatggcatcatggttgtttggtacctccaagatgccaatcatagatctttattcctttgcttcaccattctcagtgttggcctattgtccccttggttgtcattgtatgttcacaagatagcacaattcccgcatcacatccttacatcattttcaatgccaggaagcagaaatataaggggcaggtgcaaaaaaaaaaaagtgatttggcactgactagttataagaagagcactaactcctcagggtagtataacttggcaaatgttaaaacaatgaacagtaataatattgtacactttgtgtcaagcattgtgctttacaattattatctttttaatcttcacaacagtgctatgagagtaatactatgaaaatcttcttttttttttttgagacggagtcttgctctcttgccaggctggagtgcagaagcatgatctcagttcactgcaacctccacctcccggatccaagcaattcacctgcctcagctgaaaatcctcattttatagctattaaaagatgatgtagcaatattaaaaatgatttttacaaa

SEQ ID NO: 257528 - DNA, 260 bp, Homo sapiens
tagttcttccctttttctcacctcccatgccatatacacacatcatgcccctccccacaaacacacgaaaccagccttatctcaccttccaccattcccatccccacctacagctgatcatcaaaggtacacggaggaagtagtagacacggagctcaggccaatcattatcttgagaaatctaaacccagggctgtcaggctatgccccataggccatacccagcctgccaaatggtttttacatgttttaattgagga

SEQ ID NO: 257529 - DNA, 373 bp, Homo sapiens
tcttatctctatgcttaccacatttatctgttaccgcacagtatacaagcctcaaagtcaggaattgaacaaatctctctgactccaaagttttactctttcttctgcttcctacttgagtttcttgagagggtaaaagacactgaaatatgcatgcgataaggaggaaatggtcaggatactaagattataaatgtgagcataaatctgtgaaatgctgcagtgttcttggttcaacaactgtattcccattgtctaataaatgcattctatattattaatgaatattctgctagaatgtatatttcttcatttaagagatctaaaagttcatgacaattgcatcaagatgattgaagcagtctggagtaga

SEQ ID NO: 257530 - DNA, 403 bp, Homo sapiens
caaacctcttctctttttcaacagaccccaaacttctcctagataacagacgtgaaaacactttgagaaagtaaaatacaatacaaattagacttattattcttcagtaatcactcatcaattgtcttcttcagattggaaagctaagacaggaaggatggtcattttaatcttttccagtactgaatataaattcttattttcaggtgtgaggtatgatacaaatttatgagcaccccatgtttatataagtctcaaaattatgtaaataatgtttggcagaatttcttagtatggtttttggaaagcctaggtttatgtgaatttaatatataacataaagctattccagttgcacttttattataaaaggtaacatcattttttctcaaattaaatattt

SEQ ID NO: 257531 - DNA, 714 bp, Homo sapiens
gatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgaaaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggta

SEQ ID NO: 257532 - DNA, 326 bp, Homo sapiens
gtacaagaattcagggatgcaaggatgccttcctgcaagacagagatcattctatctaaaccaattgttttcaggttttttactaggagcacatgcatgaatgtgtatatatgtgtatagctatgcaaaaacatgaacagatgtatgcatgtgtataatctaaaacacataaaggtacatatactgacatactgaaacacatattaatataaccaaaataaaaatttcatgagacagtattaatgttaaccacatgctatatacttatatttttctttcatttgcaaaagaatgctgttatgactgtctaaacctctggcttgaga

SEQ ID NO: 257533 - DNA, 170 bp, Homo sapiens
tccagggcacaggccagaagccacgaagttatactgcctccatccacagaccgtatcacatcaaacagatcgcctccaaagaagcctccgctggctccctcatacctaccactgccctctgcatggcccctaaagccatctggaggcaaccagatgcagtcctagtctgt

SEQ ID NO: 257534 - DNA, 297 bp, Homo sapiens
gcataggatgatgcaagattgtgtccttaatagaatttaaattatgcttagtgttttgtataagaaggtcatttattgatttcttcatgttagagtctaaaccttgtccactagcatacatattttatctaacggtctttttccagaaaaaattcattaagagttattaaattggcagggtgtggtggctcacccctttagtcccagtactttgggaggccgaggcgggtgaatcacttgagcccaggagtttgagactagcctgggcaacatggcaaaaccctgtctctagaaaaa

SEQ ID NO: 257535 - DNA, 620 bp, Homo sapiens
ttttctcatgtttgctatggcttcaaacttactggcgcaaagttatttgtatgattgccttatgtttgtaatcttggctgtatccaaagttatgtccccctttttacatgtaatattgtttatttgtgccttctctctgttatagctggtcaatcttggcagaaggtcattattagtcttttctaagcaccagctttttgttgtcattctttgtattggtatttcattaattgctgctcttaccgtatttcccacttatactccctttgtttttgtttgtttttgtttttttctcataaccaatgggaaacaaaccaatccctctgggtttatcctgtagttctttttctttttcctttctttgttttgttttgttttgttttgtttctgagatggagtcttgctctgtcacccaggctggagtgcagtggtgcaatctcagctcactgcaacctgtgcctcacaggttcaagccattcttctgcctcagcctcctgagtagctgggattacaggcgcccaccaccacgcctggctaatttttatattttagtagagacggggtttcacctgggtgacatagtgagactccctttcaataaaaaattaaaagtcaagaat

SEQ ID NO: 257536 - DNA, 866 bp, Homo sapiens
ggcgatgccgaggtggagggaggatgaaaggccgagtcggagacgcaggggtacaaagactcggagatgaaggaagcagagggggagaggcacggcttccgaaagagcgggaggcctggagaggctttcaagagctggatcaccaagagggagcaacagggtgctacagagagactggagtgtgagggcaaaaggagtcctggggaaaacaggagggaaaggttgaagagggcaggctggttggggtctgtgggaggcaggcgccctccctgtccgtcttccctggcccctccagcctccagctcaccctcctctgttgcctgcccctctggtgggtctaggggcagccagaaggagccctctccgacccattcacaacctcctcttctgcccgagtcccttcccaccccacacccagcccttcctccacaacttccctgagccgcctcctgccttccagaaccttgcactcaattccacctgaaatgtcctccctgcattgccccagagcagacagggggttggagtcagggggctgtgccctgactgctgctccctgaggccacctgctgccatccagaccatctcctgcctcatggggaatcattgcattgttcaacaaacattttttgagcacctactatgtaccaggtcccatacaaggccctgggggcaccaagtgaccagggcagacccagttcttgccttctcagaccaccttccaagcggtgcaccctggtaggccagagcttctcctaggtcgccctggtggctctgaggtctctcttgacagctttctctgagggctcctgctgaaatggctgtgacttcatttgtagagtgggaacaataaccaggcctgtttg

SEQ ID NO: 257537 - DNA, 663 bp, Homo sapiens
caaaagactatatgctctttaagtttaggcaagctagtaaggaagtgagaaaagcaagacctgaactttgatctggagcaaatcactttacctttgaacctttttccctctctgtacaatgaaatggcaatccctgccctgcttgccttctgttgttttggatgacctcattagccattagacaacatatttgaaagtaatctctgattttattttttatttatttttattattttttttcaactaggggcatacccagatatctctgattttaaatcttccgccaacctaatactgtttcaggtggacagtaggtgcctgttaacaagtcataggtggtgggaggatccctgcacttaaaaatttcatttcactggaaatcttctcagagtgctaaacacttgagggattcaccatattaagttgctatcactgattcacatatatggagacacctctagatgtgaacagagcagtcccaggaaggaggtatgtgagagtgttatatgctgcccagccatggctctcccatcaacgcttgcttcactggctagtttagcaagaatgagagggtgttgctcactggtttgctctgatgggaagcttggcattctcctgcagcaataagaggtcctgtctatttttctagttaggtcccaaatc

SEQ ID NO: 257538 - DNA, 451 bp, Homo sapiens
taataatcaattgttatccctgtaagttccaggaaatttagtttaaggtttcttataggaaatatggataggcaaaagttcctctataaaaactctgcccaaatcacctatttctggggcacattgcttataataggtactgaatgaatatgttctaaatgaataagtagataaaccacaaacactttcaaccccttgacccttgtgagacttttacccctaccttactttcaaaacagaactccagaggcaagagttaaacaaaggccaccaggacacagaatgtagcaatgctgggatgtgcggtgagagaacagggaagagagaccttagctgggtctgtcctctgatgtttggtgtgactgctgacacatggcaggacctcagtaagcattggttggatggatagatgaatgagtgagtcagatcatctagctttgaagatctcagt

SEQ ID NO: 257539 - DNA, 2051 bp, Homo sapiens
ctggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgtcctggcctcccacagtgtcctggcctcccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctccttatagtgcgt

SEQ ID NO: 257540 - DNA, 336 bp, Homo sapiens
aacgtttttagtaagagtacatgaactctgaggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctcttgactatggggattagctctttctgtatcatcccttgccttaacctgtattagaaatggtaattctaatatataatcataaaatgcttgaataaagaatatcttatggaaagtttatggaggcaggtgtgtccttcag

SEQ ID NO: 257541 - DNA, 283 bp, Homo sapiens
ctttgaatagacagcatagggacctggcatctgacatgcctgggaggcagcttagggacccataacaggggtgggacggggacttgctgacttggtgaccattggcaggtcatatccctctctgagcctccatttcctagggacagtcattctgccctgctatctcacagggctggcatgaggctcagaggcgggcagagatggataagagctttgtaatctgtagcatgctgtgtatgtatatgcaattgctgttattaattttaaagatattctgctgtag

SEQ ID NO: 257542 - DNA, 425 bp, Homo sapiens
gtttttccatggcaggcaggagcatggcaggcaggagctttaggtaacaaggctgatggctccagctcccagctccagctggtggctcctggtgacaggcctccagctcttggcctcaagtgatcctcccacctcagcctcccaagtagctgggattacaggcatgagccaccccatctggctctcatttcttgcattctctttctttctttctggcttgaggttatcgagaatggaccaccgctgtccttcatggtgagatggtagagctggggcctcgccgtgaggggattgtgggcctgatatggtgcaggtagtatctgaggcagctggctggttgacgtttgtgtgttttgttttgtttttttttttagatgaggtttcgctcttgttgcccaggctggagagcagtggcacaatctcgg

SEQ ID NO: 257543 - DNA, 339 bp, Homo sapiens
aattctaaatatcaccccaaaatacagataccttacttcttagttggcattattcaagtttattcactttgtgctgcaaatgtttgaattagaaaacaggagagaactcccgcagcagagatgcacttctctgctctcctgtcagtcacagaacccacactgggtgattagccagaggggcgggctcctttgttgacttaagagttcaccaggcaagatggaacaattatcttgttgcctcttcttaactgtctattgttgacttacttctagtatgcttccattgtacaaaattctatccaaaattgaagaataaatcgtaagttaaaaaggtaataa

SEQ ID NO: 257544 - DNA, 339 bp, Homo sapiens
ctacttcatcaagctacacagatagcttcatcctattagagttggtgcctgatatcaaaaccaagaaagaggccctttggcctatgggaaaattctcacatgtatgtgtgacatgtcccatttttgaatctgtcctctctttttactgatgtaaactcattaaatggcatgcggtccctagcatgggcgcttcataattacttgacagctatgctctagttccatggagtagcttagttcataataatggtgagcaaacatcaaatgcgatttgaaagatatttttttccactgactaatccaacataggatattctgctactttacttgctaaattaa

SEQ ID NO: 257545 - DNA, 417 bp, Homo sapiens
gacgtcaagggtgcaatgtgccatgattgagccacgaaactccaacctgggcaagagaatgagaacctgcctgaaaaacaaaaacaaaaacacacaatcaaaattctgagcccataaaaaatatgattgataagtgtaactgcatcaaaattaaagtttttgtatggtgaaaaacatcattagaaagaaagtaaaaaaacaaacaaacaaaaaaagaaagaaagtcaaaaggcaatcaaggcaatcaacaaactgggaaaaaaaggtgcattggagctggcctgcacttatatgagctgattgttacgttttcaggaattttgcaagctggttgtcacagttattattaaaaattaaattatagaaactttaaagtatgttagaatcaaaagtaataaatactgaaaaactcatcac

SEQ ID NO: 257546 - DNA, 567 bp, Homo sapiens
gctttgtcacgcaggctggagcgcgatgattggatctcagctcactgcaacttccgcctcccgggttcaagcaattctcgtgcctcagcctcccaagtggctggtactacaggcacgtgccaacacgccgatagttttcgtatttttagtagagacgggtttcaccacgttggccaggctggtctagaactcctgaccacgtgatccacctgcctcggcctccgaagtgctgggattacaggcttgagccaccgcgcccagcaagaaaggggttttgaaccctaatgcagttcctgtttttgtttccatcccctattggctgggatcagaccgcacaatctaagctgatcctggtaagcttagacccaaactttttccaaataaagtaaatgcgcgatttgcgagaaaaggaaaagggggtagaagaagaggtagggttgatttacaacttttacaacttatgaccagaaagttgagtcatttaaaaggaacttagttgtcctaacacctctttacctcaagtgatccgcccgcctcggcctcccaaaacgttgggattacaggcgt

SEQ ID NO: 257547 - DNA, 390 bp, Homo sapiens
atatgacttaaaatccatcctcaggaaactactgatcttcccctaaaactacatcatgctttgccaagttccagcatctctgctcctgctgttccctccgcctagaatgatccacttcatcctgggtccttgtctcttctttatggaactaagtttttgcatccttcagagcagggtcactctcaaagcacggcttgacaaggcttcagctcaattgctcaagctactccaaatacactgcatttgtgatgtaccccgcttccaaccagactgttaccctaaccctcttttatgtgtgaaaattctggagctaccacttcaaagaccagttcacatctcaccttcaccgtgaaaatctcatctgatagtgaagtgaatcactccctccca

SEQ ID NO: 257548 - DNA, 1546 bp, Homo sapiens
  misc_feature (549)..(549): n is a, c, g, or t
  misc_feature (1211)..(1211): n is a, c, g, or t
  misc_feature (1232)..(1232): n is a, c, g, or t
  misc_feature (1542)..(1542): n is a, c, g, or t
cagccatttggtgtgtctcagcaaatcccgctgagttccgaggccgcctaggtatgcaatcctgctgagagttgttcccaggtcagagaatggagagagcctgtgcatgatgggatatccctgcctagatctttcagtgagtctctacctcagctactcttaggatcagggggagaaccatggaaaggcccggtgtcagacatccggaaagaagagggatgaatgtttcacctctgaagtacatcccaaatgtgggagttaacttcagctttgctggggtctacttggccagcgaaactctgcctggttcattcgcacatccggaagccacttcacggggagccgtcgcaaccggaaccacacacttggcatcggcggttgagccaaatggggactcgtggtgcaagcaacgctccccacgtgttagcgtgcgtgagattcaattggcggaattttactaggtgcgtgttggtagagcggggctgaggttttcttgctcctgtggatgtataggaagtcaaaggtcctgcccagccctgcggtcccctnagtcaactctgtttcggagacataacgatttggattgctaacaagtcaagaaatgttcaagtccttggatgtagggaaaagaaagagagatcagactgtcactgtgtctatgtcgaaagggaagacataagagactctattttgaaaaggacctgtactttaaacaattgctttgctgagatgttgttcatttgtagctttgccccagccactttgccccagccgctttgacccaacttggagcacacaaaaacctatgttgtataaaatcaaggtttaagggatctagggctgtgcaggacgtgccttgttaaccaaatgtttacaagcagtatactttgtaaaagtcattgccattctctagtctcaataaaccagggacacaatgcaccgtggaaagccgcagggacctctgcccttgaaagcagggtattgtccaaagtttctccccatgcgatagtctgaaatatggcctcgtgggatgagaaagacctgactgtcccccagcctgacacccgtaaagcgtctgtgctgaggtgtattagtcaaagaggaaagcctcttgcagttgacatggaggaaggccactgtctcctgcttgcccctgggaactgaatgtctcggtgtaaaacccgatcgtacatttgttcaactctgagctnggagaaaagctgccctgtggngggaggcgagacatgttggcagtaatgctgccttgttattctttactccgctgagatgtttgggtggagagagacataaatctggcctacgtgcacgtccaggcatagtaccttcccttgaacttaattatgatatagattcttttgctcacatgttttttgttgacctccttattatcaccctgctctcctagtatattcctttttgctgaaataatgaaaatcataatcaataaaaactgagggaactcagaggccggtgcaggtccttggtgtgctgagtgccggtcccctggacccactgttgttnccct

SEQ ID NO: 257549 - DNA, 674 bp, Homo sapiens
caggaatgcagcagcacaattacactggctaatttgtttttgttttagttttgtaatgacagggtctccctaggttgcctaggctggtctcaaactcctgggctcaagtgatcctcccgccttgaccaaagtgctggtattataggcatgaaccactatggccggttgcttccaagtattttcaatccagttagtcaaatctagatatggaacccacagatagggagggctgactacattttgtaaatttataggatttatgggctaaaaaaacaaaaaacaaaaaactgggaaaattgtagacttccctactttttttttttttgagatgaagttttgctcttgttgcccaggctggagtgcaatggcgcaacctcggctcactgcaacctccgcctgctgggttcaagcaattctgtttttgctttttttttgagatggcgtcttgctctgtcgcccaggctggagtgcagtggcgcgatttctgctcactgcaagctccgcctcccaggttcatgccattctcctgcctcagcctcccgagtagctgggactacaggcgcccaccaccacacccagctaattttttgtatttttagtagagacggggtttcaccgtgttagccaggatggtctggatctcctaaccccgtgatctgcccgcctcagcctcc

SEQ ID NO: 257550 - DNA, 281 bp, Homo sapiens
cccattttgtttaaatatgtgtgtatttgtctgtgtgtacatgcttgtgtttgattgaatcaaatgaaaatttggctgtttttgacttatataaaaggcaatttcataaggttcaacctagtgcatgcacacaaacacacacacacacacacacacacacagaaaagtctgtaagaacctacactaaattgttaacagtagttttagatggtggaaaaatatttgatctttattttctttataccttttcatattttctgaaaagtggcagaagtttaaca

SEQ ID NO: 257551 - DNA, 431 bp, Homo sapiens
gtggatatcaaggacttatacaaacatgaaatgtcctgagactccagaaaaagggaggggagagtaatcagggaaagctttgaaggatggggacaactatactaaataaaaaggtgaaaagcaatcagcgtatggaagaaagtctattaactagaattgagttcatctgtgagtaacagaagtgccaaaataacaatggctgaaagaagacaaaagtttgttttactctcatataaaagaaattaagttgctagggacctaggttctttctatcttgcttctccaccatctttagtgtattgcctcgtggtttaatatggctgcttatgctccagccactacattcagaatccacacaccaggaagaaagaaggtaaagtgaaagggacaaagaacttaggctaagttcttttaccattttgttggacaga

SEQ ID NO: 257552 - DNA, 470 bp, Homo sapiens
aaaatttttgtccaccaggttacagatgttggaatgcatactgcaaggcaagcagtatactgattccttaccatagattaatgaaataaggagctagctcatactgtgattcacaaatagaagaaagggaggaatgcccaagagtgactgaaaggaagagtcacagaaaaagatgttaaatacgagggctccactttctctatttcagactttttaactctaagattctttttggaacaagaatagaatgaagaacaggatcagaataagggatgaggtataggaaaacccacattccaagaaatcatgctaacaactgacttgtaacttttggtgagttacactgttctttaataaaagggaagaaagactcttgatgagtaaagcaaatggccaatgtggggttggatctggattcatttgttcatatgatcttcaaatcttgcctatacagagtaaaaatatcacct

SEQ ID NO: 257553 - DNA, 862 bp, Homo sapiens
ctgtgcagctgctcccgagattttctttaaaacatatttgtgtgcgttattgtcaggagaggttccttttcttttttaatacaatagataatcattgggcatacaaggggagagggcaccatgtgatcataacagatgttttttggagcagcctgaaatttatcagggaaaacaaatgactactcagataatacaataaattatacttgacatatgagcaaagctcacatactgagggcgttccaagggctgtcgctcttctgaccgttgtgtttagggaacacagcaggggcagagtctcaaagaatttattctccacatgcgtaagcaagggagtacgcaccacagattgtcaggcaaagcctcaggaataggtagagaccttcagggtgtggttggtgaagcttgagttttctaggtcgatgggggcaataagcttggagatccagttatgttgtgagtatggacttgaccctagttaagtagggattgttgatatgtttgtttttgttgcaatggtaggtcactctagttcttacgtctgggcgtagaataacattacttgcacaagggtgctggcggtaggagctttgcaagagattgtaaaagaaccagtctaggacttgacaattagggagtgagggtgcgaagccaagggaaaagaaagagtctaaaattgatcctgggtgactgagataatagaaaagtcacaaggcgtaggtttccagggaagatgagtttttagcctatttgttagtctcatgggatgagtgaagaaatcacaagaaagtaattaggttatcttgggtttcagtcagtattgactaggtgacataggtgaactaggtactctagagatgta

SEQ ID NO: 257554 - DNA, 366 bp, Homo sapiens
ttgtttttttgtttttttattcagaggcagagtcttgctctgctgttgcccagcctggagtgcagtggtactatcatagctcactgcaggcctcaaactcctgggctcaagggatcctcccacctcaacctcctgagtatctgggactataggcgtgcactgccacacccgtcttttcgtttgtttgtttgttttacagattgggtcttgctatatcgcacaggctggtcttaaacttctggcttcaaatgatactcctgcttcagcctcccaaagcactgggcttacagctcctcttttattttaataatccatgccaattttatattctactccataatacatgtgttttttgttttttcgttt

SEQ ID NO: 257555 - DNA, 526 bp, Homo sapiens
tgcacctgtgtttcagggatgacagttgtagctattttcgttcttaatttggaaagatgagataatagctcgtattctggtgcgttgtaaattaaaaatgtcgtcaggcattaccgtgctcaatgacagctatggcatgtccaagccttgctcaccttcaagactttgttcttgctgattgttcagcttgagtgctagaatgttctttacaccctcagttccccatcagccttcatctccagataggctgtgttcatcctttgaagcctctcggtgaagccttttctcaaacctaaggacgttcctcctgagactgtcttcatgcaccctcctgacttggagcccgtctggctgtgtcatttgagggcagcatctgaggaggaatcttctttggccatcgccacggccctagttggggtcttgcactgagcagatgttactcgaattctttctgcggattgagtagaacggcctggcactggctttgtgggattcacattgtaactgctatggaatgggctggaga

SEQ ID NO: 257556 - DNA, 575 bp, Homo sapiens
cgagtgagggtatttccatgctcactaccaaggttcagggacatgctccccagaaatagtctgtgatgaagcacgtggtagaataaggcatcccacttcacatgaactcttgttttctatatttgtttttttttctaagttatgataatctgaaaatgacagaatttacacagttggagtatatttcctgagatcccaccacataaagaaaagatcacaatataaggcatgaagagtgggaactcacagacccggcgtattcaccagtgtgctccctgacctggagaacacaactgcagttgccaggctggccctgtgaagcccacaaatcaggacacgccacttaatggcaccaccagcaacatagccttcccttggagactcaataatatctgaacccttcacggcgtggagctgctgatgttcctaactacaaattcaggctccacagaaaacatggcttctctttattttagattatcttattttataaaaagcaagaatatataaaagatatagagaaaaaaggcagacagaagccactgcccagtgagaacgtgctggaatataaaaat

SEQ ID NO: 257557 - DNA, 366 bp, Homo sapiens
ttgcacatttctggaataacttaaaatacctgacttttcagtaccaccctgcctgataattggttgacctgcagatttatctttagcagagtaaaaatatcactctgctcgaggaaacattgttagaattttatagcaagctctgaagtgagtaacagccaactgatcttcaaggttgtcctctgtgatattcctctgagttggcccaaaagaacctcgcacaggttttaaaagaaaaaaataaggtgccaataaagtgcagtaaaattatttactttaattatgtttaattaacacattctttccctagaacttttgctttgcttggccctctttccttgactattcaagtacttactaagtaaa

SEQ ID NO: 257558 - DNA, 385 bp, Homo sapiens
tttttctttttgctgttctgattaggtaatttcaaatgttctgtctttgggctctcagattctttcctgtttgaccaacttaattgctaacctttaagttgcttctgagtcagggagacattccatatgagcatgtgggctgtatgggaaatccggccagggatttgggccttcctgtggatcgtgcacctctgaagcactatggtgccccactgatcagaatgaagagcatctactgagatctgcatggtagttgctgagatcagcactcctactctttgtctccagatcacctcaggtgggtcagccctcttgttactcccaatgcttctggtagaacaggaccaaagcaggttttccatgaagattccgagactagtaggga

SEQ ID NO: 257559 - DNA, 243 bp, Homo sapiens
gtgtttctctctctgcctttgcttctgatgtccccctctacctggaatgctctctctccccctcccctagaatttgaactcattcttttaaaacttaacatttgtcaccagctattcctgaaagcctttcctggtttccctttcttccttttcccagcatcctccaccaagctaggttaggtccccctctttagagttctatcataccttgtacataattttattacggtactttggttggga

SEQ ID NO: 257560 - DNA, 411 bp, Homo sapiens
ttgttagtatatggaaatgctactaatttttgtatatttttgtggcctcaactttactgaatggatatattagctctattttttgtttgtttggtatagtctttatggttttctgtatcttcaaatcacttcatctgtaaacagtgagaattttacttctttattcctgatttgaatgcctttttgtttctttttcttacctaattgttctggcttgatttctcactactatgttgaatagaagtgttgagattgggcacctctgtcttgtttctgatactagaggaaactttcagcatttcactgtttactctgttgagatggatacttttgtatgtatgttgtttggagtttttattatgaaaatgtatttacttctgttataggcttttaataaattttttgagagga

SEQ ID NO: 257561 - DNA, 650 bp, Homo sapiens
gaagaaagtttccttcctctttctgggatgtagggggctggcccggtgcagagttttgacataggaaatgtttgtccttggcactctgccatctccttattcatacttctacatctcaaaaccctactccttggccgcaaaacccagccctctgctatgtgcatccaaccatgactctccacccagatctgcctttcttgtcactaagcgtttcatcttctaaacacatcacccttgcctaccttctccccacactcctccccaagctccaccttgcaggatagctatggctagctgagtcaaaaacaacagcaacaacaaaagctgtcttttcatgcttgcatgttttcttagatatttagaagttatatatatgtggagcaatcggaccctttggtagtctcttcctaataagcaaactgctaatggctcaggatttaaaagacatactacataaattatttccccctatggaataaatatgcaagctgaaaataaactacagatcctaatagccaagcagaaggagtatacttgtctaagcgaaacatcttctatgtaatttggcttgtcaaacaatgtgaagtaggatgaaagcatctttacaatgtgcagctggtgtgagagtgtcacacagatgctaattgttt

SEQ ID NO: 257562 - DNA, 456 bp, Homo sapiens
gcttcaacaatgatcaactcgaggtcaatcttgttttatctctacccctactcactcctgcctcctagtattaatttgaggcaacacatttgtaaatgttttggtaggtattgctaaaaataagggctcttgtataaaacataaccacaaatacatgtcattatacatttatccaaacccacagaatgtacaacaccaagagtgaaccctaatgtgagctatggacttggggtgatgatggtgtgtcagtgcaggctcactactgtatcaaatgctctgctctgctgggggatgttgatactgtggcaggctgtgcacaacgtgggggcagtctctgtaccatcttctcaattttcctgtgaacttaaaactactctaaaaaagttaagtcttaaaaaataaaatcaaaagagcaaagctcctgttattaaatctaaaaaatgaacaataattctt

SEQ ID NO: 257563 - DNA, 340 bp, Homo sapiens
aatgcacatgtagaggcggaacaggactgagctgcgcctgtagaaaattgaatgtgtccattgatccgctaagtctgaataaactctcattcttgttagcacagcaattagtcctcatggtcactggagcattgaaacaaggcagtttggcccacttgtcttgttttcctgtattcccaaacatgaaacacgtccagattgggacagaacaaacctccttcactttcaatcaccacccgcttcaaattaagaagtagactgagaagcggcaacagcatggaggtgacatttaatctcaagatctacccactgctgttgctcaacattagcttggcccttt

SEQ ID NO: 257564 - DNA, 1879 bp, Homo sapiens
catcctgccactaacagatttctccaaacatctctgcacctcagagtgcaaataccatcaaacatttcactccattgataggaagcatccttcactatcttctaccaaggcctttctcctttgttgcttcaaaattttttatgaaaggaacatccattttattcaaagcacctccaaacctgcagtcctaagttccaggcaactcaatcccaaaaatccactgtagatgcccaaagggtggggtgttcggtcttcaacatttttgcctttatggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagccccaagggcaggtagtaattttttcagaaaaaggtaaggcaatcatttatctcagtctgcccaggacagtcccaatttacacatgtatattctcccaatctgtaggctgtcttttcattttgttgattatttcatttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttgttgttgttgcctgagcttttggtgtgatatccaaaaatatcattgccaagatcaatatcaagaaactttccccctatgtttcttacagaaattttatggtttcagatttttcatctattttgagtatatttttgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattctcccaatccatgaacatgaaatatctttccattcacttgtgtcttcttcaatttctttcatcaatgttttatagttttcattgtgcagatctttcacttacctggttaaatttattcctacaatttcattctttttgatattagggtaaattgaattattttcttgatttctataaattatttattatcatactcatacttgtcaggcctttgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctc

SEQ ID NO: 257565 - DNA, 431 bp, Homo sapiens
  misc_feature (32)..(32): n is a, c, g, or t
cggcacgagggcgcgcatgagcggacgctgcntacgggtggccgggcgggatgtaatcggctgctgagctggcagttctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccggcgccagctgcagccccggccgcccactcgcctcatctgagcctgggcgaatctggactgggaaagttgatattaatcaactcattattcctcacagatttgtattctccagagtatccaggtccttctcagagaattaaaaagcctgtacaggtctaca

SEQ ID NO: 257566 - DNA, 572 bp, Homo sapiens
  misc_feature (32)..(32): n is a, c, g, or t
cggcacgagggcgcgcatgagcggacgctgcntacgggtggccgggcgggatgtaatcggctgctgagctggcagttctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccggcgccagctgcagccccggccgcccactcgcctcatctgagcctgggcgaatctggactgggaaagttgatattaatcaactcattattcctcacagatttgtattctccagagtatccaggtccttctcagagaattaaaaagcctgtacaggtctacatattggtatttttaattgatgataagctggaataatattaatacacacaaagcacgtgttgtaactttcattatgcttccctagaggtaagatgcaaatttgcccttagccagtgtaagatggtaaatatgacttcataaa

SEQ ID NO: 257567 - DNA, 2170 bp, Homo sapiens
catcctgccactaacagatttctccaaacatctctgcacctcagagtgcaaataccatcaaacatttcactccattgataggaagcatccttcactatcttctaccaaggcctttctcctttgttgcttcaaaattttttatgaaaggaacatccattttattcaaagcacctccaaacctgcagtcctaagttccaggcaactcaatcccaaaaatccactgtagatgcccaaagggtggggtgttcggtcttcaacatttttgcctttatggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagccccaagggcaggtagtaattttttcagaaaaaggtaaggcaatcatttatctcagtctgcccaggacagtcccaatttacacatgtatattctcccaatctgtaggctgtcttttcattttgttgattatttcatttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttgttgttgttgcctgagcttttggtgtgatatccaaaaatatcattgccaagatcaatatcaagaaactttccccctatgtttcttacagaaattttatggtttcagatttttcatctattttgagtatatttttgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattctcccaatccatgaacatgaaatatctttccattcacttgtgtcttcttcaatttctttcatcaatgttttatagttttcattgtgcagatctttcacttacctggttaaatttattcctacaatttcattctttttgatattagggtaaattgaattattttcttgatttctataaattatttattatcatactcatacttgtcaggcctttgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcacacaaagcctgttggtggactctcttcacacagatgcgcaagacaatactaacaccaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaaggtgctctatgatggtgtccaatagacaattaaaattc

SEQ ID NO: 257568 - DNA, 2078 bp, Homo sapiens
gttgaatatttaaggttgagtaaagtgggtgagtttaacagatattttcccttatttcttttaggcgaatctggactgggaaagttgatattaatcaactcattattcctcacagatttgtattctccagagtatccaggtccttctcagagaattaaaaagcctgtacaggtctacatattggtatttttaattgatgataagctggaataatattaatacacacaaagcacgtgttgtaactttcattatgcttccctagaggtggaacaatccaaagttttaatcagagaaggtggtgttcagttgctgcttacaatagttgataccccagtatttggagatgcagtggataacagtaattgctggcagcctgctatcaattacattgatagtaaatttgaggactacctaaatgcagaatcgcaagtgaacagatgtcagatgcctggtaacagggtgcagtgttgtttatacttcattgtctcctgcatgacatggagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttgttgttgttgcctgagcttttggtgtgatatccaaaaatatcattgccaagatcaatatcaagaaactttccccctatgtttcttacagaaattttatggtttcagatttttcatctattttgagtatatttttgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattctcccaatccatgaacatgaaatatctttccattcacttgtgtcttcttcaatttctttcatcaatgttttatagttttcattgtgcagatctttcacttacctggttaaatttattcctacaatttcattctttttgatattagggtaaattgaattattttcttgatttctataaattatttattatcatactcatacttgtcaggcctttgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcacacaaagcctgttggtggactctcttcacacagatgcgcaagacaatactaacaccaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaaggtgctctatgatggtgtccaatagacaattaaaattc

SEQ ID NO: 257569 - DNA, 1181 bp, Homo sapiens
tcacgctttatacttctcataacagctctattatttaaaaaacaccaagtatttcttggtaatccactgactcctcaatgaggtgcccaaattttttgaacaaagcattcatcaaatttgactaattaaaattgatgtttaattagtttaaccattcaggcaagtagttctaacctctaaaccacacctcttttttatttatttatttatttatttatttttgccatttcaggtcttttgtggtttcatatgaatttcagaattgtttttcctatttctgtgaaaaatgccattgacattttgatagggattgtgttgaatctatatattgctttggatagtatggatgttttaacactattaattctcccaatccatgaacatgaaatatctttccattcacttgtgtcttcttcaatttctttcatcaatgttttatagttttcattgtgcagatctttcacttacctggttaaatttattcctacaatttcattctttttgatattagggtaaattgaattattttcttgatttctataaattatttattatcatactcatacttgtcaggcctttgggcccaagcctgcatgtatacatccagatggcctgaaataactgaagaatcacaaaagaagtgaaaatggccagttcctgccttaactggtgacattaccttgtgaaattccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcacacaaagcctgttggtggactctcttcacacagatgcgcaagacaatactaacaccaatattattttgattcgtcagatggaaaagtaaggcttgaagaggttagaaataacttttccaaggtcacagagctaattgccacaactataactcagctctagtatgtgaacaaagatttttttataccaaaccaaaattatttatttctactccactattctatcatggtgcattttaggtgctaatgggaaaaggtgctctatgatggtgtccaatagacaattaaaattc

SEQ ID NO: 257570 - DNA, 461 bp, Homo sapiens
ggtagataaactcaaacatccctaccatcacccctggtaggaaatcactggtgtaatgtatgatattaacatctgcaccaattactcttataggtggaacaatccaaagttttaatcagagaaggtggtgttcagttgctgcttacaatagttgataccccagtatttggagatgcagtggataacagtaattggtaaaaaggatttgtcctcacaactttccagtgtatttggggtactggggtggttaaactttctcttcttaacattttaaaactcttcttagcaaaggtcaccaaacttcaagtaacatgacaggtttgtataccaactttgccacttatttgacaaagtttaacttcaaagttaaacaaagaagtttaacttctttgaacccatttactttttgataaaatggagataatacctatcataaaattgttttgaagacatattccaaa

SEQ ID NO: 257571 - DNA, 291 bp, Homo sapiens
cagacagaattttaaggagaaagagaacaaacccataacaatcattgcagacttcaacactcctttctcagtaatcactagaacaagcagacaggaaatcagcaaggatagggaagaccttaacacgatcaaccaacttgacctaattattatttatgaaacactttacctaaaggcagcagaacacatctttcctattacaaactgaacattgacctaaacaaacaatgtttcaggccatatacaaacctctacatttttttttaattcatcataacgagtatgttccct

SEQ ID NO: 257572 - DNA, 414 bp, Homo sapiens
ggtggtggtggaatttcgcatacctcagggcttagtaaaaaccatgagttgttctgctaatggacacagaccatctggaattagaattgccatgtgaaattttcgaatctgatagttgaataatttcttagggatagagtagtcatcttgagatgagttctatgaaacatgattattattattttacttttgctttgtgctgtcttggttaaccaaaacactatcttttcctgctaaaaaagtctccgttccctccacattagctctttaataataatatttcccctatatctcagccttcttattgccttgcctatgaactactcatcagtagtcaaatcagagtcactctttcctgcagttgattgtgaagagcagggagacaaaccaggagagaaaaacaaaactcaattt

SEQ ID NO: 257573 - DNA, 442 bp, Homo sapiens
tgatgggcagcaccccctcccgtctggagtctgccggggcccttcctgctctccttgttaatttattttctgtcttggagggaagctgggtgcacctgctcaggtggccccctagggccagaagacctgtcagtcactttcaaatacatgttctttccagctcttccttgccaaaggttctaaaaacactgttgtccgtctcacccaaaaagctaagcttctgtccaatccttaacggtagctataaatgagaagcataagcttggtttccttctaacatccggcaagttagaagataaaacgtatttcttcacttattcatcacatatttgcagggcacccctacacgggacagcagaggtcccaggccggtgctgcacccggagccaggctcggagctggccgcgcgccctcagctgaaactcaccggaggcgcggccgc

SEQ ID NO: 257574 - DNA, 681 bp, Homo sapiens
aacaatgagagaactagtcgatgaaatataaaataatgttggcaaatcttagctagactaaccaagaaaaaatagagaagactcaaataaataaaatcagaaatgaaagaagaaacaatacaactcataccataaaaatacaaatgatcataagggattactataaacaattatttgacaataaattggaaggccaagaagaaatgataaatttctggaaatgtacaccctactatgactgaatcatgaagaaaccgaaaatttaaacagaccaatagtgaataagaagattgcatcaccaataaaaaactgattaaaaacctctcagcaaagaagctcaggaagagatggctttgttaataaatgccaccaaacattttttaaaaattaccagttctttatatactcttccaaattattgaagaaaaaccacatttccaaactcattaaatgaggctagtatttctgtgatatcaaagccaaagactttataagataagaaaattacaggtcaatattcttgatgaataaagatgcaaaaattctcaacaaacttaaatactcacaaacagaattcaacagcacattaaaagtatcacacctcatgatcaagagagatttatccttgagatgcagggatgattcaacatatgcaaatcaataaatgtagtacaccacatt

SEQ ID NO: 257575 - DNA, 405 bp, Homo sapiens
tggtgtgatggggaaaccaaggcccagagagggcctgttttggagtggaatcagcctcactggcagtggcggtgagcagcaggcttgtgacctgttctatccctagggccgaagcctttcttttcagctgggaagacttttgggattggacgcctggaaatgctgggtggcttcaaggggggcgccatccagatcctgaagcagagggcctaccagtgcagcaggcagtgttcccagcacgcagggcaggatgagagctgacccttccccttctctgcctctccataggctgtgggtttgagccatgctgcagaggctggcccaggcagtgcccctcctccagccaccctgtggagcagggactggacttggctcctccttcactaacaggctcttttccaatca

SEQ ID NO: 257576 - DNA, 580 bp, Homo sapiens
gcacaatgttcaggttagctacatatgtatacatgtgccatgctggtgtgctgcacagaatcagccatttctgtgagaagccctggtccccttcactggagaatggtattaaaaaccaaaatctgggcactaagtgtacataaactaatttttaataacaccaagtgagcatatatattatggtacttaagagtccaaactcccctaattcttaactgagatcttactatgagctcatcttgggggatccaaatgatgttcttcaattctagatatagcaatatcctaaaaacctcaagatacttcatccctttaaatttaactgtgtactgaagttggacacgaaagaatctctgaacacttcagaaaaaagtttttaaacagaatctcgcaatccctaatgactagatagcaagctaggtaaagcagtctatgtacgtattttcctgacaattaatattaagacaagatacaattacagaagatattttttcaaattaaaaatgcttaaaattgagaaatgccttaaagaaaaatgaaaaatattttaatatttaggtaaattgctcaaaacgaaagc

SEQ ID NO: 257577 - DNA, 434 bp, Homo sapiens
agggcacgatgcttggagctggccaagagaagagtggcctccagagtggagcctgggtccatccttttcagcactgccccacccagggccattccaagaggaaccgtgactggatgaggagggtgggagcggttcatgtggagcctggtactggcagactgcctgttggtctagctggggcagtggaggcgatggtggttgtggccatggtgtggagggggcgtttgctcagtggccagtactgctctgtgctgtgtggcccattcccacctgtggtgagctgggagctggctctcagggaggaaatcccgacccatagtgttggctgtgtctcaggtgtgagcactcccaccacagcactctccactgcctgtgggtggggctgcggcatcggccccagcatgccctggttcaggcctgcgggggcggccgct

SEQ ID NO: 257578 - DNA, 418 bp, Homo sapiens
gagttgccagatcattttcaaatggctgtgcatcaaggctcacctgggagcttgtaaacatagtggtgcttggcccgtaagaggccggatccacaggggaaggtcccagtagttcagattttcagagttcttcccaggaaaccgtgaagcatactagtgataagggcatctgggctgcaccattaaccagctcaaaaatagttcattcagaatttccccatgactatttcattattttgttattagggttgatagttttaatacataaaaatagaggataaatgataatattttatatataaataaaaaacatatatgtataatagtatatttaatacataagaatagaagataaataataaataaaaataggtatatttgaatttctgataatgcatattcttgcatgcatatgtcc

SEQ ID NO: 257579 - DNA, 378 bp, Homo sapiens
aatcttcacactaaaaacttatttaacccttattacctgatacaacacatctgggctttgacataaaattacaaggcatactaaaagtcaagaaaaacttctagagataaaatactaccatcagaatcagattcaaacatgacacaaattttggaattatcaggcaggaaatttaaaataattataattaatgagctaagggctctgaagtaaaatgagctaagggctctagacaacatgcaagaacagatgagtaatatatgcagagttggagactctaagaaagaataaaaaggaaataccagaaataaaaacaactgtaacagaatgaagaatgcctctgatgggctcataagcagattggatacagccaaaaaa

SEQ ID NO: 257580 - DNA, 690 bp, Homo sapiens
ccggtctgcaggaatttggctcgaggaaaatttagttataaaatattaatgtgatgcaattctattttgtttaaagatactggtctctgtgtgtttaacttatgggaggactagaaggaaaatgttttgttgaactacaacttgagtccatatacctagtagatctgtctgctagtttccgttacattctatattcgtttattcagtattcactcattcattctatatttatttgtccgataactcttgcccttctagatgctaatatgtcatctgtcacaattccacagcaaaagtactatggaaaaagatgggtctgctttattcactgaaaaattaaagaacacttcaaaaaggaactgatacttgagtttattcattgttcattcaagaaatatacttattgagcacttgcgacatgctagtcactgtcctttgtgcttgcaacaaatcagtgaaccttaaaaacaaaaacacaacatactcctgttcttatgatgtaatcttgagagatggtgattgtttcatcaaacagaaatcacaatagttatcaatttatttgtgtgattctcccactggactctaagttccttaagaagggaactctggcttgtactgctgtatctctgatgcccattgttcagacccataataggcacacagtaaatatttttgaataactaatactat

SEQ ID NO: 257581 - DNA, 284 bp, Homo sapiens
tggcattcaactacctgggtttgaacccacttaacatctatgaactggggcaggactcatagagccctataatataattgttagaaatgtggacttgagccaaatttcctcagactgccacataataactgaggtctttggcaagttacttaactcctctgagcttcagtttcctcatctacaaaatgtgaacaataatagtacgtgtggcataggtttgttgtgaacagtaaatgacttacgactttgcaatatacttggtacataataagtactcactatgt

SEQ ID NO: 257582 - DNA, 363 bp, Homo sapiens
tatgagtgtccttgtcctggtgctctgctatacacctgaacataacctatgcttcagacaaaagcaaggtctctcatttggaacaaggataatctgcttaaaaatctaaatctctaataaatggctgacgtgtgcaagaatatcatagtacatagctctttgtaaggtaattttaaaagaaaatggtacgcattttgctcagccaagcaatctgaaagttcaaaaggtaagaagcacttctcagcatgaaactgtcaaacatatttgaaaagaaagttaattacaattggcattttcaagccttctgctggccatggctatcttactgaaaggtgacattagtgacatccattgtataggggc

SEQ ID NO: 257583 - DNA, 503 bp, Homo sapiens
ctgagggttaaatactgtaggttaagaatttagtagataataaaagtggattaaaggaatttttggactcaaatgtccttactctgcccttaaaccgatgtctagatgagctgatgtggcaactggaagcctggaaatcaagatttctgcttgctcttctattaccctatccatgaacttgggtttccatgtttagatagctcaaggtctggagacaatgacaaatttgactttttaagacaacaaaccctggggacttagaaactgtttagaaacaaacaagactctaacttaaaacagaaagtcatcattctgcttcattgcccaggttttgtcggagtgaccttgagagtgtacgcaatgatgaggcaagcaattaataagggaggattttaaatgtctctataaaaataggatcaaaaacttagatcaattataatgaaaataattaaaacacattaatttggacaactgtcagtaaactattggacgtttctatctca

SEQ ID NO: 257584 - DNA, 460 bp, Homo sapiens
ttttttgcctactgtccttgttggtatagcctgctagctgagaggtagcaaccaggtggatgcatggaagaatatcagtttagctctattgagttttactagtgtgatctatggaggactggctcactctagagaggatgggatgatgcttatcagtcctttggcctctgccccttgtgccaagtcttgagagggctgatgcatagccagataggcaggccaagctccttgaggctagacctagactgctgctgggctttgcaaaacccaactggggatgggtcctgggctgctctctgtggttctgaagcaccatctcccgccagtgtggctgctcccccttaatctgcatctctggtgtctcctatacagcctctgccagaaattcaaaagcagagagggcttttattttctatcttccaaaataaatttcaaagtattattggcaaacttgaatagt

SEQ ID NO: 257585 - DNA, 318 bp, Homo sapiens
aaggcccccccctcccaggggcctccaggtagacggtgttatactagagatgtaactgagagagccaaataggcaggccaagctccttgaggctagacctagactgctgctgggctttgcaaaacccaactggggatgggtcctgggctgctctctgtggttctgaagcaccatctcccgccagtgtggctgctcccccttaatctgcatctctggtgtctcctatacagcctctgccagaaattcaaaagcagagagggcttttattttctatcttccaaaataaatttcaaagtattattggcaaacttgaatagt

SEQ ID NO: 257586 - DNA, 773 bp, Homo sapiens
gactgagcaaatggaggaaaaggaaaccgcctttcagttcaaccgactcactgcatgatatattggcctttctgggtctttggtggctatactcgtttggcttttctccttcccagcttggaggctgctttatccaaatgctttcttcagtcctcaacttggcgtttcaacccgaatccgccttttcttccatcttagatctgccttcttatgtgtttctccagctcttcgtttaaaactccttcaaatcgtatttcagttttgactggtatagcatacattggcaactgttacacgcagcggctcttttcctcataataccgtatttggtttaatttgtgtaagtcctgccttgcgaattggattttaagttcgagaagggcaagggcagaaccgttcttttgtctgttccacaccccgggtgcggggcctgggaagtagaggctttgcttactactccatactgcaaaccttagtgtacctgcctttgcagggcagctattctcatgctcttaataaccctgaataaacctcagaattgcatttccaagttttctgtagctaccacaagacggacctccagtaacacttgttctgtccactttaggacctggtcatcagctacgaagtcccagtagctaaccgtgagggtgagacccaactaggtctttgattataggcccacttgattctcttcctattcctgtagaaatactcttgaccaaattattctgaaacttaaagtttacgaaaaatcaagggctgtgattttg

SEQ ID NO: 257587 - DNA, 472 bp, Homo sapiens
ttttttttttaaacttggcagtctgaagagatttggcctctttgtagtggtttttgtgctaatattgatccaaatttagtttcagtgcctgttttcttctctttcctattcagtcaactatttaacctctcagtgattttagttgtcctgaaatttggtctttcttagcaaggacagtttgttttatgttctttaatagttagaggatgactgggttcattcccgtaataccagaactttgggaggcttgagataggaggatcatgagctcaggaattcaagaccagcctgtgcaatatactgagacccccttctctacaaaaaataaaaacattagctgggtgtggttgcatgggcctgtagtcccagctacttgggagtataaagtggaaggattgcttgaacacaggaggttaaggctgcagtgagctatgttgctgccactgcactccagcctgggtgaccctgtctt

SEQ ID NO: 257588 - DNA, 545 bp, Homo sapiens
caagtattttatttttaagacaagagtctccctcttgctgcccaggctggagtgcagtggcatgttcatgacttactgtagccttgacttcttgggaccaggtgattctcccttagtctcctgagtagctgggaccacaggcgcatgccaccatgtccagctaactttttctatttttcgtagtagagatggggttttgccctattgcccaggctggtctcgaactcctggactcaagcaatctgcctgccttggtcttccaaagttctgggattacaggcacgagccaccattcctgtcctttactgtatcttatagatttttaattcataaatatctggtagggttgattcccctagtacagttcttggaatgtattaaaaactgcattaaaaaaacaaaaactacttttggttgtttggatcatgtttctttgaatatggtttcattcagatagtggacctcataggtccagatgtcataagggttacccatatatacccagtgttaacatgttgagaaaaacggaaaaccccatagtggtc

SEQ ID NO: 257589 - DNA, 1224 bp, Homo sapiens
tgtttatactttccacaaagatacagaatgattaatgctgaaaaataaatatgaaaagccttacaatcaaattaggagagcgcttgataaaataagccctcttcttgtgagtaatttgaaagaataactgtttttcattacaatctcagctcccagcaggtcctacataaaccaagccagctgcggttcaagaaaaggtccaaaggaggacccactcgaggtgaggataaatcacaattgtgatcacagaccaggtttctatcttttttattccctttaataaattgggcttgacctgaaactccaagaaagttaatttataacagccaaaataattttttttacgtaacagcccacctttctttttcttttaaacttaaaccattatgacaaatggagatttattacataccataaacacatgtggcttgagcactggtatttagtctggaaactcagatggggcagtaagctgctgctgcaatcaggaaatgccatgtgacattcttgataaagacgaaacacacacacattccacagcacttattgtggccacagtggttttggccattgtgtgggcaccacagccccagtgcagggctgtgaagtgaaagatgattcagcagacgaaggaaagatactcctgtcagagccacagtcacttgagtcagaaaggtcttcacaagggccaccagagtctttaattagagatgagcaaagaaaaccagcttcccaagacatttctcccacataggcctggtcttctcctccttatccatgcctaaaataaccctacaagtggttcgcatgttttggtccagagatactcagtaatgctatacagaaccatcctgaaacatgaagttgggtgcactgatgaataaatagaatcttgggtgcactgatgaataaatagaatcttgggtgatccttcttctcccttcccttggccaggctgaaatgatctatttcttctcaactgatcattcttgtagtcctcactggcaacaagcacttggtgatttatcagctaagcagggttctctggaaggtcatattaactggtggttaaagacatgaactttggagccaatcctagctccaccactttcccaaaccatctaaacctaagtttttccatctgtaaaatgggaatattgaagtaccctatgtgtctgtggggaggattcagtgaaataatacatgtatatcacatagatttac

SEQ ID NO: 257590 - DNA, 377 bp, Homo sapiens
cagccaccctgccccttccctcctcccagagcccgggctcttgcagactcctccccaccagtgtccacggaacactatttgcaataaaggtgaatggttaaaaataaatgaatataataaaatagtggaatgcaatatatccaggtaacaaacctgctcaggtacactctgattctaaaataaaagttgaaaaaaaaagtgggagagacagtaaaaaaataaaatagtgtaaaaatgaaggagtgaaagtctgtgttatataacttccctgtatataatttttctagtaattcagatttgaatgccctcctcccagtatggaatttagtttgtatcgatacttttaaaaccaataaataactgataaactctaaatg

SEQ ID NO: 257591 - DNA, 392 bp, Homo sapiens
ggggaggaagatttgtagtttaagctaaacgggagagaaaagccactttgatatatacatatgaagcacagattgccagtgcttgctaaggtgtatcccacaaagtattggctgccttttcatatttacgcctgttcagcccaagcagtgagtgtggaaaagtgagtaataaacatcagagaattctgaataatggcagtaaatgtaaatacactaatttaacatcttcgacttatctcgaaaaccttgccaaaccagtaatgcacattctcctgaagatgggaagagagaatgcccacaactcttcctgtcactgactgaatgggccctcctgttactctgagagactcttctcagagaaaagcagacttcgcagggtgtggtggctcaca

SEQ ID NO: 257592 - DNA, 385 bp, Homo sapiens
ggacaacttctacattaaaagcaagttttccacaggagtaacgtatttaattctgaagagggatagccttataatgttcattttgatcatgaatcatgaatatgatagcatcctttgaacacttttgccattataaccatctaatatctggtaccattaaatatttgtggagagaattatattgtgtaaatattagcaaagaattccaaacataagagcctcctctttgcctttagttttaatcagtcttaatccattcttgctaaaacaagagtttccaaacccttagcaaaatattttcttttaaaaaattaaatcttggccgggcgcggtggctcacgcctgtaatcccagcactttgggaggctgaggcaggcggatcacc

SEQ ID NO: 257593 - DNA, 238 bp, Homo sapiens
gatcctagaagctggagaaggaggaacccttggccagaagccctggagcagctctgtttgttaattatttctgtagtaaccaagggaacattggtgagcaccccacagagtaaccacaggtcagcatcaaagtaagcaagtagctggctggcagtatttcacagcatctttgcttttcttcccaaatctgcagtttgagagaggcggcttgccctgggaactctgctggtagggcatc

SEQ ID NO: 257594 - DNA, 392 bp, Homo sapiens
aaagccttcagccagattgcacacctgactcagcatcagagagttcatactggagagagacctttcgaatgtattgaatgtggaaaggcctttagtaatggttcatttcttgctcagcatcagagaattcatacaggagagaaaccttatgtgtgtaatgtgtgtgggaaagcctttagccatcgtggatacctaattgtacatcagagaattcatactggagagagaccctacgaatgtaaggaatgtaggaaagccttcagccagtatgcacaccttgctcaacatcagagagttcatactggagaaaaaccttatgaatgtaaagtatgtaggaaagccttcagccaaattgcataccttgatcaacatcagagggttcatactggaga

SEQ ID NO: 257595 - DNA, 152 bp, Homo sapiens
tcttctgtgttaatttgaatcaaagcccaggcatcctcttattccatccataaatatttcagtatgtatccctggcagataagggcttaagaacgtaaaaccaccatacattatcacgtctaaaaaataataaaaactccttcaaatatcca

SEQ ID NO: 257596 - DNA, 425 bp, Homo sapiens
tgttaacatatatgtacagatggtcccgtaatatataaattactcacacatttttttcaacttcatgcaaacactaactcccctgctccccatattaaatgctgtgcatgcactgactgaaaagtatgcttccctgaacgacttcctaaaatacagtttagtcaaaagaaataagttctcctgggttcttacaagtgaatgtgtattttattctcaatccttatcatttaagggactagctatatacaggacaactctttgtgactttttttaaaaacttgataataggcactttctacaaagaggatttgaattcaaaagactaaaattcagtctttagtatccccctttcacaaatggacctgcctgagccacaatagcttattgaatcaactcagcagaagtccagcagtagaactgtgtgc

SEQ ID NO: 257597 - DNA, 670 bp, Homo sapiens
  misc_feature (58)..(58): n is a, c, g, or t
tgaggtatatggtttccacgagatgagtcgcgagtacaagcaacccactggagtgtgnacacattaactctatgcccagaagaacttcaaaaaatgttgtattagggcgcaccaagaggatgcaaaaagattcagaactgcggagctctacagagcagacggtcagtctcctcccaaaacaaatggcacaacagaaatggcggaggcagggcaaaaatactactgacaagattgaaagaagattgaaagacacataaaccaaaggcaatgtgtggcccttgctggatctttatttgtgcaaactcaatggtaaaattacattcctgagaccttttggggaaatccgaacattaattgaggtataaggtgatataaaggtattcataattttctttggtgtgataatggtaaagtgcttatttttcttttaaactttatcagttggagatacatggctggtaaatttacagtgaaattacataatgtctgaagtttactttaaaatacctcagagggggaaaaaagcatgcaaatgagtgtgtgtataagagctgggatacgtaaaacagaactggcaaatatcaacaacctgagctgaggcatgggtacaggagaaggctcattctgtatttttgtgcatgtttaaacatatccacaataaaaatttcct

SEQ ID NO: 257598 - DNA, 748 bp, Homo sapiens
tactactaaattcgcggccgcgtcgatgaacagtcatgaattatactatttcaaaacatgtgggatgcaggtaaagcaggacttaagggtaagtttattgacttaagtcttccaaaaaaagatgtaaatgaattaagttcaattcaaaagttagaaaatgaaacacagaaaagctggagggaaaaagaacagaaaaaatagaaataagttaataatgcagtcatcttttattaacaggtagctgagaagattggattgaactaaggcattattctgagggaggttggtctgtaatattcctctctttaatatccttggttctgtctcggtgctgtgctagcctgatagaagaattgggcagtcttgagccaggtatgatgctcgcctgcagtctcagctgcttgagagacagacagtaggattgtttgaagccaggcatttgagaccagcctaggcaacatagtaagacagaaaaggggaaaaaaaaaaaaaggtgtgctaatgtaaagagaaattaaaagtaggacttctgttgtcttaaatagtttctgcctcagtgagtaactactcaacttatgtagaaatggctcagtattttttcagcgcacactttgtgccagatgctgtgctaggtattgaggacacatagatgactacgatatgacccatactcctgtggcactcagtctgagggagcatataaatttgtaagtaaaaaattagaatcaggcaataaatgtcagtagac

SEQ ID NO: 257599 - DNA, 190 bp, Homo sapiens
cgtatcttcatatccaaagtgggaggtggagtagtatttttatctctgccagtatttctcaaagtgtggtcttctggtcacctgtgccatgaaacagtgtctgacagtggtattgcagttgtgggggtgggtaggaacagtgtaccctggtagggaggagtattttatcacttctatcaattctgtgtta

SEQ ID NO: 257600 - DNA, 305 bp, Homo sapiens
actctaagtttgcttcgtgataactaagcacactatttttgaatgtcattagaacctaagttctctggagagtataacatgccgattaagagcttagtatcaacactggaatattattcaggttttaaaaagaatgggatcctgccatttcctacaacacagattgacctggaggacattatgctaagtgaaataaggcagacacaaaaataaaaatattgcatgatatcatttacatgtggtatctaaggaagaaaagaggtcacatacacagcgaataaaacagtggttgccggggcagggaa

SEQ ID NO: 257601 - DNA, 458 bp, Homo sapiens
ctttaaaatatttggttaaactttgatcatggcagccttgacctccccagactcaggtgatcctcccacctcaccctccccagtggctgggaccacaggagtacgccatcacgcttggctaatttttgcatttttttgtagacatggagtttcatcatgttgcccaggccggtctcaaactcctgggctcaagtgctccacccaccttggcctaccaaagtgttgggattataggcatgagccactgtgcctagccaggttaaactttaaatatagcacttctctgcatgtcagtgaatgttcactatgaataatgattttttttaaaagacccagagagagagaaaaagagagagggaaagagagagagaatgaaaagagaggaattgggggcaacattaagtatattctgtcctcttgtctttgggtcacactcaagatacaacatcccaggagac

SEQ ID NO: 257602 - DNA, 656 bp, Homo sapiens
aaagacttttgcattatcacctaatttaatcctcaaaattgtcttctaatttagtttgagctaatttattttgactttacagatgaagaaactgagtctcagagaggtgacagaatgggttactttaaaatcaaatttctcaagtgtccaaacagccaatctgttctttctctaaatttctgacctcagtcacttagatattttaggggtggacgtagattttgagggggcggtagcagcaaggtgagaggactggtagtgagcagggctgtcgcttttcagccgtagttacctagctgacttatttatgagtattcaggcatacgttacacacataaaaagcagtgtgttcaaaggaagcctcatataccaaagtctggatttataagactcaaatgagtgattgttattccactgttcaaggctttttttttctcccttcttactctatcaaagtattcctcatagggtttcttaaaagagcaatctcagtctcccagcatgcttttaaaatgcaatttattgcccacattttattagcattccactgcttagtaatgcagtccatgtttaaaatggcaggtatccactcatagaattgtgccagtctgagatgtcattagcttggtacttccagttgtcttcatggttgtttt

SEQ ID NO: 257603 - DNA, 341 bp, Homo sapiens
caaactgttggggcaggtatgtttgcacaaaaacttatccattttacaaacataaaagcaaaaagtacaaatggataagggacaagttcctttatagacgtaagcccacaaatagccaggagtgggttttctttctttctggaggccaggatgtttgggacactctcgatttcacagaccaggctgtgcctgcctccagaactcacccacaactgccccagaagaccaccttcaaggctcctgaccaagacatgggccacactgggagatgcagcctcagtttcagagcaagcttcccagggatcctccctcctggggctcctggctccccgggaactggg

SEQ ID NO: 257604 - DNA, 479 bp, Homo sapiens
gctctctctacgtgtgccactgccagcccaccccaaggctcgggccacagtcctgcaggtctccccattttcacatgttgcccgtggcagctcccggagggcagtgccgggtggcagctgatcacataggcacaggaggcaggtggcctaagcaaggggctccactttggagttgctgccatccttctccaggtgttcatcgggcagctgtgctgggggcaccatgatggcccagtctctgctgctactctcgatatgccaacagaccaccgtggatctgctccagtaaatatttgctgactgactgactgacttaggttcttaaatgcctatggtccagccttatataaagagagagaaggctgggcgtggtggctcatgcctgtaatgccggcatattaggaggccaaggcaggaggatctcttgagaccaggagtttaagaccagcctggtcaatacagtgagacccgatctatac

SEQ ID NO: 257605 - DNA, 416 bp, Homo sapiens
ggtgcagcaaaccaccatggcacgtgtatacctaagtaaaaaacctgaacattctgcacgtgtaccccagaacttaaagtataataataaaaaaagttttatgtcttcatgatgatgttaacttaccataaattaaattatttatatatatatgcatttgaaaaattaggcataacatcaaattcatctatgtcaaactccttattttacatgttaaaatattttttaaaaatatttaattctcttattcatgaaaaataattacagtttctctccttgaatgcaatgcttcctgtatcttatcctggttaatttttaagtttcctaacgatcaccttccaaaatattcaatattctaacttctaatattaattaatggagtttgaaatttatctaaataaaacactgtaatataa

SEQ ID NO: 257606 - DNA, 324 bp, Homo sapiens
gaaagaagcaaccacattgatgagtagaatgaattgaaaattcagaaaatacaaagagcagagagaagaaaataaaaagcatatatagtcccatcacagactttcccagttaaaattttgccatatgccctttgagactttttcccatgtacatatctctatcttgtatttatttctgatttatcaattgaagcaactggaattgctcattttgcaggttaaacatgactaatgacaacttcagatggttcaacctaacacttctgaaaatgtctggggataacttataatagtaaaatatataaaacaggtcatttttttaaa

SEQ ID NO: 257607 - DNA, 855 bp, Homo sapiens
cagattcctgggtgcaaggtggcctcattagtgcccggagaccgccccatctccagggagcagatagacagacaagggggtgatcaggggcacagtgatccaaccctggcctctgaacgccgcagcggccattccttgggcccagcctggagacggcccccctgcagcaggctaatcttagacttgcctttgtctggcctgggtgtggacgcaagtgcctgtcaattccccgccacctcagagcactataaaccccagacccctgggagtgggtcacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctgagtcgttcttcgggccctgtcctggcccaggcctctgccctctgcccacccagcgtcagcccccagaaaaaaggcaataaagacgagtctccattcgtg

SEQ ID NO: 257608 - DNA, 521 bp, Homo sapiens
tgaagtgaatggagggtggcggtaggtatcaaaaacaaaaaatttcaggtctcctgggccgccgtgacgctactgctgctgctgctgctgctgccgcccgcgctgttgtcgtccggggcggctgcacagcccctgcccgactgctgtcgtcaaaagacttgctcttgccgcctctacgagctgctgcacggcgcgggcaatcacgcggccggcatcctcacgctgggcaagcggaggtccgggcccccgggcctccagggtcggctgcagcgcctcctgcaggccagcggcaaccacgccgcgggcatcctgaccatgggccgccgcgcaggcgcagagccagcgccgcgcccctgcctcgggcgccgctgttccgccccggccgccgcctccgtcgcgcccggaggacagtccgggatctgagtcgttcttcgggccctgtcctggcccaggcctctgccctctgcccacccagcgtcagcccccagaaaaaaggcaataaagacgagtctccattcgtg

SEQ ID NO: 257609 - DNA, 423 bp, Homo sapiens
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggaagggccctggacactgcagcaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccg

SEQ ID NO: 257610 - DNA, 399 bp, Homo sapiens
ctgcagctgcctgaaggagccatctcatccacagctcttccttgagcagccatggccagctccaggcgaggcctcctgctcctgctgctgctgactgcccaccttggaccctcagaggctcagcactggtcccatggctggtaccctggaggaaagcgagccctcagctcagcccaggatccccagaatgcccttaggcccccaggcagcccagtccagactgcccatggcctcccaagtgatgccctggctcccctggacgacagcatgccctgggagggcaggaccacggcccagtggtcccttcacaggaagcgacacctggcacggacactgctgaccgcagcccgagagccccgccccgccccgccatcctccaataaagtgtgaggttctccg

SEQ ID NO: 257611 - DNA, 542 bp, Homo sapiens
agtgaggtggcctggtgcagccccactggagggtgtttttaagttcttgcagtgacaagttgtcacattttctttttgcttcatccagatgcatgaatcaaagcaactgaagtctgaaagggaatgaaatgccatgagccagtatctgtaacctgcgggtgacaactcgagagcaacaagtgactgggtttaagatgatctccttttaaaggcgtctttaaagcaaaaggaagcatgtgtgttagggatccacgcgcatgtgatgaaccacatagagcagtgaagtggtgcaaatggaaaattcagtagccagtacatggggcgaggaggtagtgagatggcacgagggaacagcacatgcgtgaatgcaaaggcgtacgccacaacacccggctcatttttgtattttttgtagagacagagtttcaccaggttgtgcaggctggtctctagttcctgggttcaagcagttctcctgtcccagcctcccaaaatgctgagatggcaaggtgtgagtcaccgttcctgaccatcatctctca

SEQ ID NO: 257612 - DNA, 691 bp, Homo sapiens
atggctactctgatctacgttgataaggaaattggagaaccaggcacccgtgtggctgccaaggatgtgctgaagctggagtctagaccttcaatcaaagcattagatgggatatctcaagttttaacaccacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttgaattgccagctgtttgctatgacatagatatttaaatttcttagtgctttggagtttgtgtgtacttgtattaataaagcattatttgtttaacaacataataaatacataaatat

SEQ ID NO: 257613 - DNA, 229 bp, Homo sapiens
acccgttcagaacagtgtaaagaaagagtaagtgggtctaaagaccacaaggtgttgactttcctttttcccagcagacacacacctgtgcaaaataatttgggtgagcttctttggaggacggtggcagttctttgttcaaaggaactgcacattttgaagccagattaattgatttctgcacgctcttggcaaagagccctttaattgatgatttcacagcaattag

SEQ ID NO: 257614 - DNA, 352 bp, Homo sapiens
ttatttttgaagatgagaatagttttgtgacccacctgggtgggaggggatgagaagaattataacctttttaccttaaaactttcctgataaggcactaaaccactgggctggtctacactggtccaaaagacatttatttccttccttccttccttccttccttccttccttccttccttccttccttccttccttgctttctgcctttcttccctcctttccttttctttcctttccttcctttcctttcctttcctttcctttcctttcctttcctttcctttcctttcctttcctttcctttcctttcctttcctttcctttcctttctcttttcttttctttcatc

SEQ ID NO: 257615 - DNA, 505 bp, Homo sapiens
tgaaaactgaaaagatgcatatgattagtcatcagaaagatgtttgacttctaagttttttccaacagcaggtatggctgcatggaaaatgcatacatccattgttgcaaggcctttatttccttatcaccatcatcaagcagtattaatgaagaagccaattgtgcatgacatagtgcaggtctctgtatgtagttatggaaaacgcttccacagttaaattgagtatggatatgtaaagtgattaaccaagacttgacagctcacacaattctttaattgcagcaagcatctcaagtaaatacataacttttaagaaaatccagaactataaagtcttaatttttgaaacaaatcatgatctttcacgttacaaacagatctttctttctaaaaagatgattcacaatcttttatgctggaacatcaaacatagattttactttacttctttttaaaataattggtttgttaacagttaggaaagccatacgtgttatttgtt

SEQ ID NO: 257616 - DNA, 1889 bp, Homo sapiens
  misc_feature (1)..(2): n is a, c, g, or t
  misc_feature (6)..(7): n is a, c, g, or t
  misc_feature (9)..(9): n is a, c, g, or t
  misc_feature (1843)..(1843): n is a, c, g, or t
nnagcnncngtaaggatagcatcaactggcaaacggagaaggaggagaacagagtggagaggaaccctgttaggagaaattgagcggcattccatctggtaggcaagtttgcatttctcctttttgggatctgcccaggaatgttgtcaagtgtaatggctcccctgtgggcctgcatcctggtggctgcaggaattctagccacagatacacatcatccccaggattctgctctgtatcatctcagcaagcagctattacagaaatatcataaagaagtgagacctgtttacaactggaccaaggccaccacagtctacctggacctgttcgtccatgctatattggatgtggatgcagagaatcaaatattaaagacaagtgtatggtaccaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatgtggtgatgcgcaggcaccccctggtctatgtcgtgagtctgctgattcctagcatctttctcatgctggtggacctggggagcttctacctgccacccaactgccgagccaggattgtgttcaagaccagtgtgctggtgggctacaccgtcttcagggtcaacatgtccaaccaggtgccacggagtgtagggagcacccctctgattgggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccagtgctttgggaggccatagcaggaggattgcttgagcccaggagttcgagaccagccagagcaacatagtgagaccacatctctaccagtaaataaataaataaataaataaataaataaataaataaatagctgggcatagtggctcatgcctgtactctcagctacttgggaggttgaggtgggaggattgcttgagcccaggatttcaaggctgcagtgagccatgattgcaccactgcaccccagcctgggtgacagancaagaccctgtctcaaaaaaaataaaataaaaggctttctgccttc

SEQ ID NO: 257617 - DNA, 1328 bp, Homo sapiens
  misc_feature (41)..(41): n is a, c, g, or t
  misc_feature (1282)..(1282): n is a, c, g, or t
cactcgttatgcaagtgtcaatattaaagacaagtgtatgnacaagaggtctggaatgatgaatttttatcctggaactccagcatgtttgatgagattagagagatctccctacctctaagtgccatctgggcccccgatatcatcatcaatgagtttgtggacattgaaagataccctgaccttccctatgtttatgtgaactcatctgggaccattgagaactataagcccatccaggtggtctctgcgtgcagtttagagacatatgcttttccatttgatgtccagaattgcagcctgaccttcaagagcattctgcatacagtggaagacgtagacctggcctttctgaggagcccagaagacattcagcatgacaaaaaggcgtttttgaatgacagtgagtgggaacttctatctgtgtcctccacatacagcatcctgcagagcagcgctggaggatttgcacagattcagtttaatggcacttcttcaccatctgcatggccttcttggttctcagcttagctaagtccatcgtgttggtcaaattcctccatgatgagcagcgtggtggacaggagcagcccttcttgtgccttcgaggggacaccgatgctgacaggcctagagtggaacccagggcccaacgtgctgtggtaacagagtcctcgctgtatggagagcacctggcccagccaggaaccctgaaggaagtctggtcgcagcttcaatctatcagcaactacctccaaactcaggaccagacagaccaacaggaggcagagtggctggtcctcctgtcccgctttgaccgactgctcttccaaagctaccttttcatgctggggatctacaccatcactctgtgctccctctgggcactgtggggcggcgtgtgaagactgaagtgttcttcagtaattgtgctggcacttaggagagagaggagggggaataatagtgggttaaaaagctttctgggtcgggtgtggtggttcttgcctatagtcccagtgctttgggaggccatagcaggaggattgcttgagcccaggagttcgagaccagccagagcaacatagtgagaccacatctctaccagtaaataaataaataaataaataaataaataaataaataaatagctgggcatagtggctcatgcctgtactctcagctacttgggaggttgaggtgggaggattgcttgagcccaggatttcaaggctgcagtgagccatgattgcaccactgcaccccagcctgggtgacagancaagaccctgtctcaaaaaaaataaaataaaaggctttctgccttc

SEQ ID NO: 257618 - DNA, 695 bp, Homo sapiens
agttcaacaagttcacaaaagacaagatgaacatacaaaaatctattatttttatatatattagcaatgaacccatgggcatcgaggtcaacatatatcatttacagtgattcaaaaataaaatacttgtgtgacaaaacacagagtaattaaatgttgtcaactacacaacactgaagaatgaaattaaaaactaaataaattatgaatatatatatatacatatgtaatgttattggattagaaggctcaacatagcaaaaatgtcaattttccaaaaatgatgtagagatttaacaccatttttatcacaatctcaggaattttttaaaataaatattcgagtttattttaaaatttatacggaaagtctaaataactaaaatgactaaacacttttgaagaaacaagaaggtctaaaataaaaaatacaaacaacctcaaacaatgatgcagataaatttatcactcacactttgctacttggaatgtaaaatggtgcagccacttagtaaaagtgattttcattttctttaagaaactaatcatacaactaccacatattccaagaatttcattcacgggcatttatcctacccaaaacaaaaacttatgttccctcaaaatacctgtacacagatgtttatacagctttctttgtaacagctaaaaaatggaaagatgtccttcaaggg

SEQ ID NO: 257619 - DNA, 455 bp, Homo sapiens
gtggacttcttgctgcaatattcaaaagtaattacattctgggggggaaaaaagccttttcctacccaataagtctttattataatcaaatccttatgggagtaaacttcaattaattgatgcatgaaaaataccagagacaaagtgaaccctttaatttctctaaatttggctatgcataaagaaagctgcacctaccatgcctgtcataaactgtcaatggccagtcagactgaacctgctgccctcacattgcccctgttgtgagcaagtatctccatgctctagtgaactcttactgagatagacctactatttggagctttgatgtccatcaagggttttactcccatctctatattaaagcatcatgtttttaggttttggataaacatccaatgtatgtcttttatgagtaaaacagatcacaagaaattatgatatgtgtttggttt

SEQ ID NO: 257620 - DNA, 689 bp, Homo sapiens
gaataagtcttggagacttcttgtgagtccagtaatacaatatgaagtgttttgtgtctagttcctagttgtttggtagcagaagggagctttcagtgtatctaaacaggcatattgcagaaaattgggttttacatgtatgtgtctccccttcctagactgtgagctctttgagaaacaaaatatgcctatctccagtacctagcatagtgcctggatagtaatagaccctcaaaaaatatttgttaaaagaatatatgatataataatgctttcctccctcaaaacactaccagagtacccttcgcatattcatagcatatactccttagtctgattgtttttctttgatatttattttctgaatttctacttttatgagagaaattgagggccaatcattggagtttgtttcaggtccaaactacaattccttgtctatcacccagcttcccaccccttggagtagtggttgatggttattactatgaagtttggaggataagtttacttcatgataaagttcagtctgcctaggtacttcagaatccttgggaatgtaattggtttatagattttaaatatctgtattccacacatacatcactgttggtatcctgagtctcctgaagttttctggttcagacactctgatctgtcctgcattccctgtttcccagtaaaataag

SEQ ID NO: 257621 - DNA, 356 bp, Homo sapiens
acacaggacaaagagaatctatagaaaaagggaacacataccttccttcacagggtcctgtgattttctttttcctctaaaaatttagtttttcattatttaagagtgatgaggccaggcgcggtggctcacgcctgtaatcccagcactttgggaggctgaggtgggcggatcatgaggtcaggagttcgagaccagcacggtgaaacctcatctgtactaaaaatacaaaatttaacctgctgtggtggtgcgcggctgcaatcccagctgctcaggaggctgaggcaggagaatcactcgaacccaggaggcggaggttgcagtgacctgagatggcgccatggcactccagc

SEQ ID NO: 257622 - DNA, 3457 bp, Homo sapiens
actgaaggcttccgggcatgcgcacagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcaccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaa

SEQ ID NO: 257623 - DNA, 890 bp, Homo sapiens
aagcagtggtatcaatgcagagtgcccattacggccggggtgtttgttttcttgttctggaagaaataagaaaatttaaaattgtccaccaaaataccggtaatgtgactgagcagtagaggttactctttgtgttatagaaagtacatgctttattttatacagattaagtctttatcagctaattaagtgtacctaaacttcttaaacagtggattgtttaataatatctgatttgagttggttaccttagttattgtgagtccttgattttagttagctattttctttggcagcataaaaatatcatagcatattatttaaagcatgttttaggctgattgtggtgtttatattctgagactatttttacaaatccaggtcgcagtcataaaagtacattaaaaatatgatcatgtatctttttgaaggctattttcatattttttccctcttttctttcacaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataa

SEQ ID NO: 257624 - DNA, 3553 bp, Homo sapiens
actgaaggcttccgggcatgcgcacagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcaccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattg

SEQ ID NO: 257625 - DNA, 3586 bp, Homo sapiens
actgaaggcttccgggcatgcgcacagcgttgtgcaaatgaatgccttccactgaaccgaggtagacggggtcgagtttcttgcgcgatggtgggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcaccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattg

SEQ ID NO: 257626 - DNA, 3908 bp, Homo sapiens
actgaaggcttccgggcatgcgcacagcgttgtgcaaatgaatgccttccactgaaccgaggtagacggggtcgagtttcttgcgcgatggtgggtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcaccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattg

SEQ ID NO: 257627 - DNA, 1603 bp, Homo sapiens
cagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcatttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattg

SEQ ID NO: 257628 - DNA, 3997 bp, Homo sapiens
actgaaggcttccgggcatgcgcacagcgttgtgcaaatgaatgccttccactgaaccgaggtagacggggtcgagtttcttgcgcgatggtgggcttgtatgtgtgtgtgtgtgtgtgtgtgtggggggggggggtgacgaggttggcattgaggatccataccctttgcgcccaaagaaaggtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcaccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattg

SEQ ID NO: 257629 - DNA, 2279 bp, Homo sapiens
actgaaggcttccgggcatgcgcacagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataa

SEQ ID NO: 257630 - DNA, 356 bp, Homo sapiens
tatttaaagtgctaaaggaaaaaaataaaatttattgtagaatagtatatctggtgaaaatatccttcaagcatgaagaacaaagaccttcccagacaaacaaaagctgagggatttcatcaatgctagatttgtcctaaaataaatgttaaacagagttcttcaacctgaaagacaaagatgttaatgagcaataagaaatcatctatatgaatatttacaacaaaccctcatgacgtgtttatctatgtaacaaaccttcacgtgtacccccaaatctaatataaaaattaaaatacatatatatgtacaaactcgctggtaatagtaagcacatagaaaatcagagaatatta

SEQ ID NO: 257631 - DNA, 506 bp, Homo sapiens
acgaggccagagtgctctggaggccaacaggaaggtagtctccagaattgtgcaagtgacgtactttcaggtttgctgccattcacaacagacaacctaccagctttcatggtctaaagagggcttaaatttaatttgcaaatatcttcagagaagaaatacagtctctacagtctatactgagttataagtgactgataccagctcttcattagaaggttgttctttcttctatttgccatgaactacaggggtcaaaagaagggttagcactatcctagctccctgttaattcttgcaaatcagcactcttttataaccctttgtaacatcccatttcaatgcataatagaaggtatgcagtcttccacctcctcattggtgggtgccatttacacactcctggccaatcccctcattcatgaatgatattcataccttccttaaagtcatcatgcttaatgtcttctatagcattgaataaactctgtactatttccttcaca

SEQ ID NO: 257632 - DNA, 534 bp, Homo sapiens
agatcccaccgcagccagttccgaccggattcaaacagcctcttcccccttctcgggacacccactccgcgcactcaccatttcccagcctccggatgttccgccttcttccctatggatctcccagtacctgcaggtcacaggataacaggggctatggtggagtcaccgaggagctaatggagcggaagagatggaatagtacagacgggtactggactcagagcctagaagctaggagacgaaggccttgccatattgaagagcccgcctcttcctctctagctgcgcacctgattgggcagttttcacgctagcaccactgattggctggggttctccgccccacacatttagaccctgatcgacaggagatgtaatgagacactgggctgaatgaggaaagagtgacaggtttttgcctgcagcatgttcaggcagcgatttctccttgtgttgggggcctggccctgcctgagggacatttgtatttaacgttgtatataagattatatcactttctgattataaaaa

SEQ ID NO: 257633 - DNA, 682 bp, Homo sapiens
gtggacagagggtggatacagactcaaggctgaaagagaagagagctgggaaccctacaagaggttgccaagcatcaggacttgttcctggcccccagctgctcctagggaagggctgagtgaaataggcctggagtggtccactctcaccattgatctctgggattctagctgaaggagaccccaggacccccaaggacatctgagctggcagagaaaactgcctggagagttggtagagacaaaactcctgcattaatcaagcccagaatatttgacacaggaacagctgcagtggagcatggccatgggtgcccatcccacaaagttctccatactccattaggcagctttagactttattagctgctggcattggacagagcaaggctatgcttcctgtgggatggggtctgatattacttggctgtgttgccacccaaatcttgtcttgaattatagttcccataatccccacatgttctaaaagggatccagtggaacacaattgaattatgtagatgggtctttcccatgctgttcttgtgatagtgaataagtgtcatgaaatctgatggttttataaagcagagttcctctgcacatgctctcttgcctgccaccacgtaaaatgtgcctttgctcctccttcaccttctgccatgattgtgagtcctcccta

SEQ ID NO: 257634 - DNA, 277 bp, Homo sapiens
atcagcttccaggtatttgcagtttattatgtgctaaatactgtaatagatactttttatgcatgaatccatttattctcacaaaaccccttggggaagtgaaacagattatttccatagtgtcttaaaaccccagaactctgcgttgctgcgtctattgacatgaacacctgtcaaacctgcaactcatagctcagtattgtctcagtccaatccaaggaaatgaactccttgagaaagctgacattctggaccatggggtagaagctaccctgtc

SEQ ID NO: 257635 - DNA, 221 bp, Homo sapiens
ccccctcagggccgaatcactttttgggagggaggaaaccgtcaagaccagttctgtctacagtgggttaacaggttctaagagggagttttgctttaaacttaattctgtgttcacggttgctgttgtcactccatgtagccgttatgggtaatttgcaaggctttatgtttttaaaatctcaccatataccctaggtatgtcacttcatgcctgttttt

SEQ ID NO: 257636 - DNA, 472 bp, Homo sapiens
gatccaggaggcacaccatccaactaaggataattatagaaagagaaaataaagcatatggagcagagaaaattatttttaaacagaaaaataggaaatatcactgaactgaaagaaccttccagaatgaaaaaggccagccaaatgaatgaaaaaagacacacacaggcacaccacaaaatttcagaacacctcctaaaaagatataaagaatctcctaaaagtttccaacaaaacaacaaaaacaaacataggggggtcacacacacaaagcaggtgtcagaatggcatggtccttctcaacactatgacctgaagctaggattcagtgttatcataatgcctcaaatgctgaggtttccaatctagactaatctaccttgccaaaatatcaatcctggatataataaaggcattttcagatatgcaaggttacaaaatttctaattcccacgcaatattttacaggatc

SEQ ID NO: 257637 - DNA, 380 bp, Homo sapiens
gacctcactgattctttcctttctcctgtggactgttctcaatccagcagcaggctctgttaaaaactagttccatcattcccctcttcagctcaagacccttcaggggctccccatatcactcagggtaaaagtcgtgatcttcaaattgtctctgaagccccagcccctccctctctgtgctcatctctgctgcattgacactgggctccttgctgatctttgaacatgcgtgacatgcttctacctcagggcctttgcacttgctgttttctcccccttccttagatatagatatccatatgacttgctcttgtagtttcctcaagtcttttcacaaacatcaccttttcagtgaggtctctcctgagcacgcaatt

SEQ ID NO: 257638 - DNA, 171 bp, Homo sapiens
tttttttatatttttccaactgtctctaagtgcacatataaaatacactgtaattgctgaatttaatagtcaagtctgctattgacatgtagcaacgatatatcacagataaaaattagaaggaaatttaagtttaaagtaaatctaaatttgattgcttcttttagaaca

SEQ ID NO: 257639 - DNA, 298 bp, Homo sapiens
ccaataggccccagtgtgtgttattcccctctgtgtgtccatatgttctcaccgttcagctcccacttataattgagaacatacagtgtttggttttatgttcctgcgttagtttgctgaggataatgccttccacctccatccacttccatgcaaaggacataatctcgttcctttttacggctcattatttttcttcttaaatgctgtactaaatctgtggataagagcaccaatgttttcgttatacacatgttggaccccaacaagttgcacttgaatacatacaggcaactgc

SEQ ID NO: 257640 - DNA, 478 bp, Homo sapiens
taaattgagtataatcagtagattaaagatcagttatattatacttgaccctagttaaactatgtttacccaaacttcgttttaaaacagctttagaaaagggaagagtatgaagacagtataaagatctgtggttgccatggagcagaggaaagagggacaaatagatgacaggatttttagggctgtgagtgaaactattctgtatgatcctataatagtgtatacatgtcatatatttggcaaaccccgtagaaaatacaccaccaagagtgaaccctaatgtaagctatggactttaggtgataatggtgtgttaatgtaggtccatcagttgtaacgaatatggtgctctggtgcaagatgttaatagtggaggaggctggtggagggaatggcagtgggtatatgggaaccttctgtactttctgctcagttttgctgtgaacctaaaactactctaaaaagtaaattctta

SEQ ID NO: 257641 - DNA, 416 bp, Homo sapiens
ctttgatgtccttcatggcttccaaagtagcattttatttaggctttcttttttctccatattcttaaaggaaaagaataaaattgtagatggacctctaattatattttatctttccaggggagagcaaatattgttttaatgatattgtattagtctgttgtcatgctgctgataaagacatacccgagactgggtaattttttaaagagaaagaggtttaatgaacccacagttccacgtggccggggaggcctcacaatcgtggcagaaggcgaaagtcctggcttacatggcggcaggcaagaaagaatgagagccaagcgaaaggggaaaccccttataaaaccatcagatctcatgagacttattcactaccacgagaacattataggggaaatggcccccatgattca

SEQ ID NO: 257642 - DNA, 434 bp, Homo sapiens
actgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaatt

SEQ ID NO: 257643 - DNA, 642 bp, Homo sapiens
tagaacatggccagacgcggtggctcacgcctgtaatcccagcagtttgggaggccgaggaggctggatagcctgaagttgggagtttgagaccagcctgacctacatggagaaacctcatgtctactaaacatacaaaattagccaggcgtggtggcgcctgcctgtaaccacagctactcgggaggctgaggcaggagaatcgcttgaacccaggaggtagaggttgtgagctgagatcacgccgttgcactccagtctgggcaacaagagtgaaactccatctccaaaatataaaaacataggaatgatatataccaaatcatggtgctatttgctagggtaagaggaaggagtgggatgaaagagggagaatatagtgcttcacttataacctgtaatattttattttctcaaaagttgagggaggctgtaggtggaatatgagacaagtgtgggaatgcagtaagatctatcaaactgggtcatgagtatacagtagttgtttattggaatctgtgattctctatacaattgaaatagttaataatttttcattgttttaagtatagttctttgattattacctagattgggttattttattaaggtttgggggcattagtatttatttattttacc

SEQ ID NO: 257644 - DNA, 413 bp, Homo sapiens
caggaaaaaaaggaacttggaggaaatggatataataacatatcatatgggcttcctcttttccagttactgttctgagtgccgaatacattttgctctcatttgtacctcacaataatgccatgcgttactgtatactcttattgtttctattttactgagacaactgatgagcagagtttagataacttgcccaaggtcataggcacagtcaatggtggtgttgattgacatttaagctggatgcagagtctaaatttccagccagtacaccatatactggaaaccattcatggagtaacaggaaaagtttctgtaagcaatatccccagaaacaaaagtagattttgcacccatgaaaaagaacagaatgctatctaaaagaaataaattttttaaaagctctttaaatt

SEQ ID NO: 257645 - DNA, 214 bp, Homo sapiens
ttgacgagggggactaccgccggcgctcccgacccgcgacgcgcgagccccgggcgggcgggggaggcgagagcaagaaacctgtgggacctgtggggagccgcgtccgcggggctggcgcgcgcgggggcggcctcgggctcgcgcgcaaaggcgcgggcgcgggcgggggcggagtggcggcggcagcggcggctagaagcggcagcccaga

SEQ ID NO: 257646 - DNA, 430 bp, Homo sapiens
agaaacaaaaacaagtttagcttgaactccactgatggaagctatggatgagggccttaaaaggtggcatcataaccaagatcactaagtatgctgtggtggcttagggattatgtgatataaatgcaattggtgaccaggaggattggctgagtgagggttggctaagtgaagatcagttaaacacacagtttcttttgcatagaacaaatcagatattgactactatttgtaaagcagaatgttaagaactcctactttattttctacatttttcatatcgtgattaacaatataaattcattattaaatctctcttccatctattatataccatttcttttgccatattatccgatttaattatatcccattaaacttgtacttagtgtcctactcattttaacttttaaagtagtttctaatcttg

SEQ ID NO: 257647 - DNA, 431 bp, Homo sapiens
tagaaagcagcaccttctgggttttcttcctgaggcaacatgacaccctgggctaaaacattgaaagacatcctgtttctagggagaactaaagccagagccagtctgttccatccagttctttcgtatctcaggatgttgtattccctgcacattctataattccgtagaactaaaaacaaggggagaaccaggtcagtccaaggccacccagaaaactgttgtacactggggagaggatctatggcattggagcactgtctatacctgaggttacaagctagaactagagggaaacagtaacatgccattcagaaaatttagggatttagtgtcaatgacagcagttactgaacttttttcctttggtcagatactaacctgggtgctttctgatcatgatggatacagatgtcatcttcagattcttg

SEQ ID NO: 257648 - DNA, 419 bp, Homo sapiens
agcctaatcaagtataaaataactgataaaatagagtgtcagagagttttgtatagacctgccacttctgaataattggcattattattattaataataatgttgtacctgttattaatgttgtttttcacttgaaaatgctaaataagcatctctattaacaagctacaacctttcgatactaatagtacacaaagttaaacaaaaacatagaaagttaattaaaaccaaacaagtgagataatgaaactaaatgactattgatggcttaaactctacagctaactatgtgatggcttgatgtgtgttcataattaacctacaatttgaatatgtaaacattctgtagatttcatttagtaccacagtaattttctttttagaaaataaatcagattaactctcttttctggtcaact

SEQ ID NO: 257649 - DNA, 488 bp, Homo sapiens
ggctgtgagggaacagtcaaatgcccagagaaatgcaaacggtgtgcatgtgattgcggtttccaccatgagcttccacaccatccagggcaaattatttcatatgtagctgccacatttggcaggccttcgtaaagtgagcagacagctttatcagagctacagggaggttcagacagacccatccctgtctgaacatttctggagttctgtactctacagtccaactctgagggcaccagtttacataaattaatatccaaatcagacaggatgccaaatgcctcacattcaaatagcactgtgcagttgacaagggatttctttcctccaaagagaacttcttttaggctttcacagatactacagaatcatagaaagtagaggtgggagggacttagagatgatcaatgtcaccttttcattttataggtgagcttagagaaggtaaggaactcctgtaaggacacacggcaagttaggggcag

SEQ ID NO: 257650 - DNA, 918 bp, Homo sapiens
tgtctacaatttacttttttttggagacagtcttgctctgttgcccaggctggagtgcagtgatgtcatctcagctcactgcaacctccgcctcctgggttcaagcaattctcctgcctcagcctcccaagtagctgggattacaggcatgcaacaccatgacccactaatttttgtatatttagtagagacggggtttcaccgttttggcctggctggtctcaaactcctgacctcaagtgatcaacccacctcagcctcccaaagtgctgggattacaggcatgagccacctcgcccagcctgtaatttactctcaaatggttcaggaaaacaatgtatattttcatatagagacagagataaagacacaaaaaggatgagaatgataaagaaatgaggtaaaatgttaagtactggggaatctgggtgaagagaatgcagggattctttatactacttttgccacttttcttttagctagaaattatttcaaaacaaacagcttggccaaattagcaggtaagaaaaaattattagtgttttttattttatttcattcatgtgttcagtaaagttgaacacatggatgttaatggaccattcgggttatatggttcatattttttgctcatttttatgtcatggtgtttatcttttctgtgctgatttgtaaaagctattttaaaacccttcatctgccatatatgttacatttctttcctgctttctgccaccttccaatttgttaccaactttcttctccaaccttgggccactggcatatacactcattttaaatatcagaacttgtagtgctctttgaaatgcagacagactatggttcattctgcaactgcatattagttaacaggcaaaaataccttagtaagagaaagtgtcttttccttctaatgta

SEQ ID NO: 257651 - DNA, 1019 bp, Homo sapiens
accattcagatttcctcgtctgtaaacattaagtatctacattcactaaaagtagttctgaatgaatgttatttaatggtgccaatgatgttggaggatacctgtgcatctcatgctgtggttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcactttgggaggctgagtctaagtgtacagtgcttgtaaagtctgcagtagcatacagtaatgtccaaggctttcacatccactcaccactcgctcactgacccagccagagcaacttccagtcctgaaagctgcattcatgactcaatcaccacaattgcaatcaaaagacggctttagttggaacctggaacgtgctaatcctgtcaggcagcctgtgattctggaagtgaaggaacaaaaaaaaaaaaaaacaagggacaaatttcacataaaatttccatatgaggaacgacagatggaacacttttgtgtgtgtgcgttcagtaaaacgggcactttcttaagcaggtggcaaagaaagcctgagaatccggctgacttttctaattttcaagaaaacccctgattttccccacaacagggcggagaatagatcgaacagccacgtggcatgggtagattccaccctggctatcaacggccatgtgcaattacacctactgtggcaaggcggggcagttaccaggggcaaaagttcgtcatgccgagatggcgacggacaagcgtactgttaacagcgaaacgatacggaccaagcccccagcgccgaagggcagctgacacacagtagagtcagaactcgggcggacatgggggtaccaggagcgaaatcacaggcgagggaaccaagaaaacgaa

SEQ ID NO: 257652 - DNA, 1461 bp, Homo sapiens
accattcagatttcctcgtctgtaaacattaagtatctacattcactaaaagtagttctgaatgaatgttatttaatggtgccaatgatgttggaggatacctgtgcatctcatgctgtggttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcactttgggaggctgagtctaagtgtacagtgcttgtaaagtctgcagtagcatacagtaatgtccaaggctttcacatccactcaccactcgctcactgacccagccagagcaacttccagtcctgaaagctgcattcatgtatagtttgagggtatccagcctcagattatctgaggatgtagctcaagatttcctaattttgcaaacagcaagcttcccaggagattcttagattcctgctaacaaaaggcggagactcactggacagttactgaagatagacagtagggggcggaagggcccacgcttctttgatattggtggctttggtttttcagtgacgggggacactttgacttcagttcctttttacgacttttggtagtgaagagataaagttcattacaaaacatgccaggcttaagcaattttccaaagggattaacgaattgcagtggccgcaggctatgtaaaaatttttaaaaggtggtgtctctcatattcttcagcataacttgggtcacagaaacccaggcataaaaattcattgtgaactcatattctaccatggcctgacactgactcaatcaccacaattgcaatcaaaagacggctttagttggaacctggaacgtgctaatcctgtcaggcagcctgtgattctggaagtgaaggaacaaaaaaaaaaaaaaacaagggacaaatttcacataaaatttccatatgaggaacgacagatggaacacttttgtgtgtgtgcgttcagtaaaacgggcactttcttaagcaggtggcaaagaaagcctgagaatccggctgacttttctaattttcaagaaaacccctgattttccccacaacagggcggagaatagatcgaacagccacgtggcatgggtagattccaccctggctatcaacggccatgtgcaattacacctactgtggcaaggcggggcagttaccaggggcaaaagttcgtcatgccgagatggcgacggacaagcgtactgttaacagcgaaacgatacggaccaagcccccagcgccgaagggcagctgacacacagtagagtcagaactcgggcggacatgggggtaccaggagcgaaatcacaggcgagggaaccaagaaaacgaa

SEQ ID NO: 257653 - DNA, 1242 bp, Homo sapiens
accattcagatttcctcgtctgtaaacattaagtatctacattcactaaaagtagttctgaatgaatgttatttaatggtgccaatgatgttggaggatacctgtgcatctcatgctgtggttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcactttgggaggctgagtctaagtgtacagtgcttgtaaagtctgcagtagcatacagtaatgtccaaggctttcacatccactcaccactcgctcactgacccagccagagcaacttccagtcctgaaagctgcattcatgtatagtttgagggtatccagcctcagattatctgaggatgtagctcaagatttcctaattttgcaaacagcaagcttcccaggagattcttagattcctgctaacaaaaggcggagactcactggacagttactgaagatagacagtagggggcggaagggcccacgcttctttgatattggtggctttggtttttcagtgacgggggacactttgacttcagactcaatcaccacaattgcaatcaaaagacggctttagttggaacctggaacgtgctaatcctgtcaggcagcctgtgattctggaagtgaaggaacaaaaaaaaaaaaaaacaagggacaaatttcacataaaatttccatatgaggaacgacagatggaacacttttgtgtgtgtgcgttcagtaaaacgggcactttcttaagcaggtggcaaagaaagcctgagaatccggctgacttttctaattttcaagaaaacccctgattttccccacaacagggcggagaatagatcgaacagccacgtggcatgggtagattccaccctggctatcaacggccatgtgcaattacacctactgtggcaaggcggggcagttaccaggggcaaaagttcgtcatgccgagatggcgacggacaagcgtactgttaacagcgaaacgatacggaccaagcccccagcgccgaagggcagctgacacacagtagagtcagaactcgggcggacatgggggtaccaggagcgaaatcacaggcgagggaaccaagaaaacgaa

SEQ ID NO: 257654 - DNA, 156 bp, Homo sapiens
ggttaaacaaatagtattttttattaaatgtcactcaatcccagggctgagaattcatttgtgttttcctcctagactcaatcaccacaattgcaatcaaaagacggctttagttggaacctggaacgtgctaatcctgtcaggcagcctgtgatt

SEQ ID NO: 257655 - DNA, 687 bp, Homo sapiens
gaacattcacatacaaaacaacacacacgtgtgtatgtgtcagacatatggtgttgtaatgcctttataagagggcttcactacataataacttactataaaacaaatgttgttatttaaattattaccagcagaaaattgcctgttgtactgtattttatagagaagacagctcataaatgcactaaagtgcaaagacatttttaaaaaggcaataatgaattttcaataatgaagcctagtaatagcagtgtaagaaagcatctgaaagctgataaaatctatattttagcactgtttctatatgtacaaggtaaggctttctgatctcaattgtcagtatgaattttttgtttcaatttataaagatcaaattcacatttttgaagtgagttattattgcatatcttcatttaaggtcaggcacaattttgaacatgttaatcaaaaagaatacttattgtcatatctcacttctgacatttaagaaaaactcttcatgcaaattaagtatgtgactacactaccaaaagagtgtatcaaatacttaacacagaaatacaatgaacttctctatattgactgaagtccttcatgtgcctcttctcaagtgcaaattagactcagatttctcctctttgaagtacagttacccttgtacatacactgcttaaagcgttacttata

SEQ ID NO: 257656 - DNA, 422 bp, Homo sapiens
atcccacctaaccatctaaactactctaaattagactagaatcctggagccaagatagatacagcacatgtatcttccctttgctttaagtctgggattcaatctgctccctggcaatcagatttagaggctaagagctctctaaatcacttgtttggtcaacacatgagtctggatagaactctcctccctctaggatgaaaacagagtaaatcctaaatttggggctcataaaataacagggcaggttaagggaaagagtcatcaagcttaaggattagaaaaagattgtacttctgaacatacatattcttttgcaggaaataacatgctatttcagataaacttcagacattctaaattgactagtgaggggagagtctccgctataaagacacatgcacaagtatgtttattgcggc

SEQ ID NO: 257657 - DNA, 416 bp, Homo sapiens
tgagagggagggaacctgaatcctagctgggtcaccttctagctgtgtggccccgggaaagtcatgtcactgtgccaagcctctcactgatctgtcaaacccgagggagccagtctcgatgatctttaagttcttttcctatcacagtattcagtcctgggagatggaactgctaaaggcaggctctgcatttaggaccacagggaaaccgagagagagaatttcgggaactcccagtacaggccattatcttttagagtatattagttttaatctttctcctgaaaactttaagatctctctctttttaactgcaggttgctttatccttgtcatatattagatactgaataaatgtctctgttgaaagtccatatgtttagtggaataagtccactgggccaagagtatctatg

SEQ ID NO: 257658 - DNA, 621 bp, Homo sapiens
aagtggcctggatcccacaaaagcaagtcagcaggtcatggccagggccactactttggcagctggagcagctctgatggggacaactttcagtctcgtccactgatttcttgaggccattttctatgggttccttttgaactgctgtttcaactttgcttggaagaaccaggatcttttagagcttattcttagaaggtggtggagtcttagatgagagagaatctgttttcatgcagaaaatcatgggttccagttctgggagaatgcccatccacccaaacttcccatctctaggaaaatcactgcttatctttgagaaattccgcagaaggtggagaatttagtgtcactagtcacccattctgaaggtcttgcaaaatgcaactagcatatattagaccattgcacccccgttgttctacctaaactgcaatctctggctggatcatctgaaaggaaaggaagtacctctgagctcgggtgggctcagaatctgggagaaagttttatatactattacctacaggtttttactgttcatttagcttcaagcaccgacaccgccttgcaaagataaagataaagtctattagacaatttaatcatgagattctaatg

SEQ ID NO: 257659 - DNA, 217 bp, Homo sapiens
agggacatattttttttaatgtgtgggtaaagagttttccttcttcaacaagttcaattgaagaaagcttcttatgcctatttcaaaacacacgcacaaatttaggagcagtgagatgaattctcttgcagctattttgatttgagttgtttcccccttggaatttgtggatagaaactgttatattaggctccacatcattagttatatttcaact

SEQ ID NO: 257660 - DNA, 680 bp, Homo sapiens
gaaaaagccccacttaactttagctgatgtaaacaagtatatttaagaagtgtacgtaaacaagtttatttaaatataattcagcatattctcctcgaaaacattgaattcccaaacagaataataagtttaaaattaatgtggtttattaacaattaaaaatgataacacaagctgaagaagattggaggtgaaatgttgagtttcctttgataggtagagtaattacaaagtgtgcttttgaagttcaagaagacagccttaggacacaacatttttaaagtaaaaattggcttgcactctgttcaagtgatttattttgcactaagaaatgggtgtgagacatgatgtgatttaaaatttcatcccttgatggaactgcttgagggtgacatgaatttttttcttttttcttttctcagcctgctcggcctatgaagtttcctatctaaaagttaatcttctgaaattacttaggaatgtaaggaaacctaatcttttggtgtgtaaacaaaaaggactaagtatatcactccccctctgacacccaggagcccagaagtggggtgcctgctaattaattaccttcagaaaactgcacctttaccatctttctctgtctaagaaggcttgaaagatgtggggaattgaagaggggaggtagaatgtactcaaagaag

SEQ ID NO: 257661 - DNA, 346 bp, Homo sapiens
catgatggcatgcccttgtagtcccagctacttgggaggttgaggcaggaggatcgcttgagctcaggagtttgagttacagtgagctacgatcgtgtcattgccctccagcctgagtgacagagagagaccaagaaagaagctggaaaaatgactgttggctgggatgaaatgagtttctttgacttataaagtgtaaattttaagatcattactttggcaaagttagaaaagatatatctttatgcaaaagtacaagaataagacttctgttgaatttgaaatgcattctttaaacaattatccccaagattgaacagtcttctgtaatagaaattagtggaaa

SEQ ID NO: 257662 - DNA, 430 bp, Homo sapiens
ctggcctatcttctattaatttcttctaattagctattatcaggaaagcactgaatgtctgcctgatgtgattcctacccacctgatgggaacattcaatgataatgctgaacagataattcaagtgctgacacgccctgttgtctgttgtcttatcacagtgctttgagtcaaatacggcagatagcattatcttcatcagatcctggacctctgaagatgaggggacttgcccaaggccacagggaggtttcatttctctgcaaagccggatcactaagggcatgggctctggagttgggcacatctacagtcacatcccagctctgagagttactagcaatgtggctgcagtgctcctctcagtgccccccttaccctcaacactgtaggaagtcctgccaacttctgactgccatcaccttcattt

SEQ ID NO: 257663 - DNA, 262 bp, Homo sapiens
ttaggggctcttttgcaggggaaggaaagacagggggacttttgcttctacaaaggaaagactagtgccttgtctcctgggtgaggcttgtcattgggatggattcacaggcgagcagaaatggcagaatttatggggcccgtgctcccagggggtggccgctccttcagggggttccacagtagcagaaaatgcattatattttgggatcatttgttagtgtctcatttctaccatctgtatgagaataaacagaagctgc

SEQ ID NO: 257664 - DNA, 353 bp, Homo sapiens
actccaattggtgtattggtttaagaacctacctttacatagggatcccagaaaatcaagacagttagctcaaattgcaaaaactctgaagtctgaattcagtctgtgcgaccaaaggtctcggaagagggtgctcttgtaagagagatcagcctgcaaggtcccatgatcagatgacactggccacacaaaaactctggaatgcatttcaaacacaagtgtctcattacagctggcatcttagcctgcagcgggcactcttcttgggcagatgcttagcactgggagactggcagcatcaggttcttcagaaatgcttggcagaccagcttcctcctgtgtctaccccacat

SEQ ID NO: 257665 - DNA, 355 bp, Homo sapiens
gatgtatggaacgcttccccctttcaaagtgttaagtactttgctgtcagcatcaccatcacagcctgcgaactcgacactaaagagagagaagtggaaaaggcaaagtaagaacaaaagccagccacgtcacagggctcagaactcgtcctgacagctggcccctccctccccaggcctgacatgaaagggtcctttccaagctcgctggagactctctgacccccatttcttccggtcctgagccccagctattgtggtttccctgcggacacctcacatatcaccgacagcagaccagaatcccgagccttctgttcttcacatatttcccacaccttttttaccctacaac

SEQ ID NO: 257666 - DNA, 419 bp, Homo sapiens
tctctatccaccttgattcctggtgtgtttctgaaattccttatctcttaggagggagactctgccttgaaaggtacctttttgaacgtgagtatttttcactcctcacaactgtatcaaaaagggtaacaatggccaggccaggcacggtggctcacgcctgtaatcccagcactttgggaggctgaggcgggccaatcacgaggtcaggagatcaagaccatcctggtaacacggtgaaaccccgcctctactaaaaatacaaaaaaaattagctgggcgtggtggcaggcgcctgtagtcccagctactcgggaggctgaggcaagacaacagggtgaacctgggaggcggagcttgcagtgagcagagatcgcaccactgcactccagcctgggtgacagagcgagactctgtct

SEQ ID NO: 257667 - DNA, 1336 bp, Homo sapiens
ttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtatcacacctgtggagggacccttatcagacagaactgggtgatgacagctgctcactgcgtggattaccagaagactttccgcgtggtggctggagaccataacctgagccagaatgatggcactgagcagtacgtgagtgtgcagaagatcgtggtgcatccatactggaacagcgataacgtggctgccggctatgacatcgccctgctgcgcctggcccagagcgttaccctcaatagctatgtccagctgggtgttctgccccaggagggagccatcctggctaacaacagtccctgctacatcacaggctggggcaagaccaagaccaatgggcagctggcccagaccctgcagcaggcttacctgccctctgtggactatgccatctgctccagctcctcctactggggctccactgtgaagaacaccatggtgtgtgctggtggagatggagttcgctctggatgccagggtgactctgggggccccctccattgcttggtgaatggcaagtattctctccatggagtgaccagctttgtgtccagccggggctgtaatgtctccaggaagcctacagtcttcacccaggtctctgcttacatctcctggataaataatgtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacattatcatactgtgtctatttgtaattaagccctccagagcaggggtccctatgcctgatgatctgtcactgtctcccatcacccccagacaggaccgtctagttgcaggaaaacaagctcagggatcccactgattctacattatggtgagttgtataattagttcactatatattacagtgtaataataatagaaatgtagtacacaataaatgtaatgcccttgaatcatctcgaaaccatcccccaccccggttcgtggaaaattgtcttccacgaaacgggtccctggtgccaaaaaggttggggaccactgatttagaagaaatgcagttataggatccaagttggatttcaccacatctgcaggctgggtcttccctttg

SEQ ID NO: 257668 - DNA, 618 bp, Homo sapiens
atacttaactgggagccctgaggaaacaagaaaggaggtaggcaggagttactgactgtggacataactgtctttccttcaggtcatcgcctccaactgaacattttcctgagtccaacgaccttcccaaaatggttcttagatctgcaataggacttgcgatcaaaaagtaaaacacattctgaaagactattgagccattgatagaaaagcaaataaaactagatatacattatcatactgtgtctatttgtaattaagccctccagagcaggggtccctatgcctgatgatctgtcactgtctcccatcacccccagacaggaccgtctagttgcaggaaaacaagctcagggatcccactgattctacattatggtgagttgtataattagttcactatatattacagtgtaataataatagaaatgtagtacacaataaatgtaatgcccttgaatcatctcgaaaccatcccccaccccggttcgtggaaaattgtcttccacgaaacgggtccctggtgccaaaaaggttggggaccactgatttagaagaaatgcagttataggatccaagttggatttcaccacatctgcaggctgggtcttccctttg

SEQ ID NO: 257669 - DNA, 353 bp, Homo sapiens
aaatcttgacagcaacaagacaaaatggctcatcacatgcaagggagcatctgtaagattatcagcagatttttcagcagaaactttacaggccagaagtcagtaggatgatatatttaaagggctgaaagaaaaaaacctagaagaatactacatccagcaaagtgtccttcaaaaatgaaaaagaaattaagacattcctagataagagctgaggaacttcattaccactgtattttccctacaaaatcctaaagaaaatccttcaagttgaaacaaaaggatactagacaataattcaaagctatatgcaaatatgaaattccccagtaaatgtaaatatttggacaaat

SEQ ID NO: 257670 - DNA, 176 bp, Homo sapiens
ttctattttttatcctttaaaaatgcttttaaaatggattataatcatattagctaagaaatactaattatggctagcttttgggcacatagtatatatctgaatactaagcagtttacatatattcatttaatcttaataccctgtgaggttggtactattattatccgtcgact

SEQ ID NO: 257671 - DNA, 1562 bp, Homo sapiens
ttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaacattgcaaacggcatgccctgacttacagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagtggatgtccagacttccctccaggctaacactgaggctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgcatctgtataa

SEQ ID NO: 257672 - DNA, 924 bp, Homo sapiens
ttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaacattgcaaacggcatgccctgacttacagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaactcttctcccgggatacagggatacgctccccgggataccagggggatccttctagat

SEQ ID NO: 257673 - DNA, 904 bp, Homo sapiens
ttcaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaacattgcaaacggcatgccctgacttacagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaa

SEQ ID NO: 257674 - DNA, 2926 bp, Homo sapiens
atgattttttttccatggactttaaagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacatttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaatttacct

SEQ ID NO: 257675 - DNA, 619 bp, Homo sapiens
gtcattttattactttagaaaaatgttttgtaaataaacttgggaaggaggcaccaaagttgctgtgaaaagaagaacaaattatgaacaaaaaaggccaataaataaatggtagttatcatgacatccatagcgggtcttccataagtcatagtaatcattccctgcaggaaagcagccactatccatccagggacactaacatcattttattcaaagacttgagggggccaccattcacatatggtagccacacaatctttggacaagaaaatgaagagtttggggaacagcatcatctgccttaggaaaaactcagagccctggtctagaataaactctagggctctgagaaaatgattctctaaaactatcagaagtctacggaaatatggagatttttttcaaagctatgtttaaatacattcggtaaatctgaaatatattaataaacattgttatgtctttctattaagaataattgtgataagaattccccaccaaaatcacctccgtgttggctggacaacccgatgtcattgctaaaagagtgaaaatgtttcagtctctgatattaccaagtaaacataataaatggctgtgatggttaacactcagt

SEQ ID NO: 257676 - DNA, 550 bp, Homo sapiens
aggaggttgaggctgcagtcaactatgatggcaccactgcactgcgtcctcagcaacagagtgagacccttttgcccaggatgcagtgcagtggtgcctcaataaatgaatgaaaataagaaaaaaaaaagtcctaagaatccatttctttccacctctggatcgtgacccaatatcacctaagaaggagcttgggaggaatgttaagaggtgtggattctcatcctgactcttccacctcttggctttgacttcaggcagaccctggaatttttctgaaattttgcttactctgttaaatgggaatcacaatgccatccgtgcataagaaggcaccccacagacctctatttacagaaagcagaattgactatgggctcccagctgtgacactgaaatccatcatcatgtttatgctgaaaccagattccttgaggctccttctagctagttcctgggtatggaagggatactaaggcaggcccatttctgggagacatgctagacgtgcccttggcaaaacatttgtaattacttttcctggaagaaa

SEQ ID NO: 257677 - DNA, 747 bp, Homo sapiens
cacagctttgaaagggggatgggagagcgagcagaaagcagaaaaaccagctttgaactatgcatgcaaggcctctttcaagcctcaaattctataaggacggcttgagccagggcagttcaggaaacacttgaggagcagaggcagcagggcgctggaccagacagaggacgggaatgtccaagaagtggtctctgtgtgcggtaatgagccgagattacagctggcagctggaaactaaaccccatgggtgccacccagagagagctgagactgaccatggagtaacggccaaggtcatgtgtgtagccccgggccatggagagggggtaccctggaggggctgggctggctggctgggctcaggctgtctgacaggcaacgggctccccagtgttctgaagagggagtggccctggtggtaactctctgtggcttagaggggctgaagctagaacaccgctgtgactccgggcccgctggttccctgagggcaagggccaccttgggtcatcgctctgaacaccttccccttgctctgagaagcacagatggccagtgtgaactgcctcagcaatccagggactgtgtcctctcattaagatatcatggcaaatcacgagaagacacaaaaatcaaaacatgcaagagaagaaaagactaatgaaagcagagattccctgcgcggctctttctaagctgactagaagagcagcaggcactccgataacttccgcacagtccatt

SEQ ID NO: 257678 - DNA, 567 bp, Homo sapiens
attctctagtcaacagatatttattgagcatctactacatttcaggcatcttaaacttacttcctgtttataacttactgttgattttgcacatggtgaatattttctatttagttgagatgtgcacctcctctctagttttataatatcaaattaagtctcttctgttcaattgaagcctcatatgccaaaaaatagccatgaactgacatgacaaagaatgagtaaccagaggcatcggcatttcaatgtgttataaatatttgaatgtgtgtgtgtgaagggggtatttttttcttgatgttaccagtgtaaataatccaaatataagtatatatgaataaatgtttagatacacataaattatacctttgaaatatccacaccacagtgtcttagaaccagggtactttgcttatgaagaaaataggagtggcggtctttttaatcaaatagaagcatgctttacaccatatctgcatggatattaaaatataatccttagcctatacctgaggtttttttcctagcataatgcaaaattaaaagatcacatctaatcacctt

SEQ ID NO: 257679 - DNA, 251 bp, Homo sapiens
ttgcccgctccaccatcggcaatcactttcccatatttttgctacccctgctgtgatagatgtatctcagttccttggttatgccatcctcgggataatcacacatgctgcttcacgccctacaatccagtttcatcctctctgcatcctgctaactccttctattcctccaggacttgggtcacttcacttctcttcatttctttctgttttcttttcttttcttttttttttttttttttgagacggag

SEQ ID NO: 257680 - DNA, 422 bp, Homo sapiens
atgtgaccttatttggagaaagggtctttgcagatgtaagtaagtgaaggatcttaagatgagatcatcctggactacacccaatgataagtgtccttaaagagacagaagagaagacacacagagaacgccatgtgaaaatggaggcagagattggagggatataggcacctggaatgcagagggagtgaattcctgccaacacataaatttcagacttctgggccccagattgtgaagaataaatttctattgttttaagccactcagtttgtggacatttgttacagaagccctaggaagctaatacaaccctcaccacctgctttcccaagttgtgttaacaaatatctaatatttatttagcacttgttatattcagctttaaatagataattacattaaactttcacagcaatctt

SEQ ID NO: 257681 - DNA, 347 bp, Homo sapiens
ctaattgatgcaggagtgatttatggggaaatctaggggacagagtttagtgagacaggtgtagtggggccagagtatagagtgcacagtggggaagtggtgagggagaaggcgcaagtgatcaacagggcagccagatcatgcaggtcctttaggtaagacaggtatgtttgtcacacaaaccagaatatgtaaagattaatatagagttcgataattaagccaagacaacagatctaaactggggctgttcatggcctgctggtgaatccataaaccttaacagaaagttttgttttttttgttttttttgttttgttttgttttgtttttggtaagggtagtag

SEQ ID NO: 257682 - DNA, 1471 bp, Homo sapiens
aggattattcgtcttctccccattccgctgccgccgctgccaggcctctggctgctgaggagaagcaggcccagtagctgccaccatccagcagctgctgccgcagccattacccggctgcggtccagagccaagcagcggctgagcgaggggcatcagctaccgccaagtccagagccatttccatcctgcagagccccgccaccagcagcttctgccatctctctcctcctttttcttcagccacaggctcccagacaggacagccatcatcaaagagatcgttagcagaaacaaaaggagatatcaagaggatggattcgacttagacttgacctatatttatctaaacattattgctatgggatttcctgcagaaagacttgaaggcgtatacaggaacaatattgatgatgtagtaaggtttttggattcaaagcataaaaaccattacaagatacacaatctttgtgctgaaagacattatgacaccgccaaatctaattacagagttgcgcaatatccttttgaagaccataacccaccacagctagaacttatcaaacccttttgtgaagatcttgaccaatggctaagtgaagatgacaatcatgttgcagcaattcactgtaaagctggaaagggacgaactggtataatgatttatgcatatttattacatcggggcaaatttttaaaggcacaagaggccctagatttctatggggaagtaaggaccagagacaaaaagggagtaactattcccagtcagaggcgctatgtgtattactatagctacctggtaaagaatcatgtggattatagaccagtggcactgttgtttcacaagatgatgtttgaaactattccaatgttcagtggcggaacttgcaatcctcagtttgtggtctgccagctaaaggtgaagatgtattcctccaattcaggacccacacgatgggaggacaagttcatgtattttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaattgatagcatttgcagtatagagcgtgcagataatgacaaggagtatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctga

SEQ ID NO: 257683 - DNA, 533 bp, Homo sapiens
aaggtcgatagacctccttcactatctgaatttttatacacacgtacacgtataccatttctatcccccttgtcattgcggtccaagtgacttgcagatattcattgtaatcagaggatgaagaagctgcttcctaattgctcccccattttttcttctctggccagtctctctcatgtagaagtgttgtggccaccttttggaggaagacttcttttaggccgaagctctctttaccctattctcagcactttaggatttcccagattgccattccttggctgaatctactgtcttcaaaatcagttgtaaggagctctgtagtgacagaggtggttcataggtaggggtacttctggaagagggcaggcagaaaatcccagaggagtggggcttttaagaaattgtgacatagctgggcatggtggctcacacctgtaatcccacaactttgggaggccaaggtgagtggattgcttgagaccaggagttcaaaaccagcctgggcaacatagtgggaccctgtctctatt

SEQ ID NO: 257684 - DNA, 419 bp, Homo sapiens
gtaaagtttcctggatgtttaaagcatgaagcacagaagaaatctctttgcattccagtaaaaatcaataaaatatttttcatgcaaagattaaactcatggctaaaagttatgtttgtttttttaacattgctaattattttagagagctcttatttctgttataattttgtttaaagtttatttctatattcatgattaatttatttatatcttgttgctaaatctacttttttaccaagtaaattcactcagaaattctcaaagttactcactactgggccttcagggacatagtaccttcttggagatgcattcttccaatgaccccaatcagatatttttttctgtcttggacttccattgttgtactagttttgtatctgaatttaacacctactccaatctacttacatcag

SEQ ID NO: 257685 - DNA, 698 bp, Homo sapiens
ggaaaaattcaggccaaaaaaacaaaaaacaaacaaacaaactcagataagtagccccatgtggaaatactttactgtaaacattgtttttattcttcatcatcttggataaaatttactatgtattatttcccccagaataagcttttccatatactttgcaccaaacatatcctcatctcaccctatttgatctctctatgcactgttgggagagactgtgtatctgattggctgtcaaggagtatctctactcaagtgactttattactattaattttttaactcccagaaattatgaagaaaagcaaaacaaagcaatacaaaccaaattgatcaaagagaataaatgagctgacgtctgtgaaagcttggcaaaacttaaatttcttttgcctctgaagataaatatgatttctagctcccatgtcttcatctttaaagatgagttttggaagagctcactggtggtgagtgctggaagaagtaagattaatctatgtgtgctttacattatatttcccagataattgtacactttgtataccttgtaaaagttattcttatttgaaggttgatggcaatggacatttgtcatccactattatgaatttttctagacatttctatgggttatttagggtaatttagaaagcagtgttttaagttgtctaaatataaatgcaatattcatttta

SEQ ID NO: 257686 - DNA, 643 bp, Homo sapiens
gcaaaatgatcatcaggactctgcattgtttttcattaaagcatgagtctcaataactgactgcattacaggctgtccaccatttttaggggagtgcctagggctaagaatagtcattaggtacaactcagtgtgcagagtctccaacttttttgagcccattgacttagggccaggagcaataaccacaaaattgcttccctagctttctcagagcccatctgctggatttttcaattgactcactggatatcttggtatgtgaatcagaggataaagagactattgttccatgtcagaattgaaaagctcatgtaaataatacattagcattctagccgcatggtgtctgctggcactttctaagagatgattgattgacatgactggcagagtgccctgtgggatgttgagtctcttgcaattgatccagtagcctccccatcacccttccactgagagtgtcctgcaggctcactagtacctaccaaagtgttccttccagaaaggctttgtgcttcattgaccaccctgctctttgtggtagtttgttagaaacagaaatgccagtttttgagttggtctattaagataacatgccaaactcaaagtaacaattaaccttattcacttactagcatat

SEQ ID NO: 257687 - DNA, 610 bp, Homo sapiens
caggagcagaggaacaacacacagcgccatgcatgggggacaggagtggcgacgctaatatttacatgcctgccaagttggataaacaggaatatcctgagccatagaatgcaggcctttccagatcaggcccttccttatttattggaccacttttgtttaaccagcaaaagagcagtggtctccattcggttcatcagttctcccaacggcttgttagtgtctgggcagtgcggtgagacagaaagcccaggggtgtctggaatcagataggtccaggtttgaattctgctcctgccccttactgatccagtgacttggaataagttacccaaggaagaaagaacattaacttgattgagtgccttctggagccaaaggctttatcgatgctatctcattaacatagcttcttgaggcccaattacttcacctgtcaagtggggatgataaaatcatccttgaagggttatagtgaagattaaataggatgaggcattgaaagtgtttggcacatcacgagagaccttctttcctcactctaaactcttcagagtttgtacctgtatatctgccaaatcaacattattttatctctcacgaaattaaa

SEQ ID NO: 257688 - DNA, 794 bp, Homo sapiens
caagatcaccgcagaacgtgaaggcgggttgcccaacggaggatttacaaacatttgggaacgactttttctggcaggtcgctgtgagaactgcaggactttctgcacacaaagacacagtctaaacctctgcactcaaagacgaggaactctagcgtggcttataggagcatgactcaaggtcccccaccctccgctgccgcctaacctcgaccccagtaaaatgtcttcccgagaaagctcaaggcagccaggagaattccccgtttattctagccaacacccgatggtaaagcccctgacctcccttttttaggatattttcttaaaagggcttacaactgtgaatcctttctctgttgctttgagatgtatatgtatcgcctacacctcagaagtgtctttctcaaggacctgaaagccattgctctgaaatgcagtcatggggaggataggcctctgtcccccagtctctgtgggaggatagaatcccagcttcataacggccagctccaggcacagctgcccgtcattaatactgaccgccccttcatgatttttcacttgatcccctgctagcttcccggccctattctctccttcaccctttaaaacgcccattctgctatgcacaaatgagaatgatcagctttttctcctactgtaagtagttactgagtaaaatctgttttcatggtttaaaaaagaacaaacaagagagaccacgaagcagaaaaccgaacacagcaccaacaaaaagaacgagaaacaaggggggggcgaaaaaaaacaca

SEQ ID NO: 257689 - DNA, 449 bp, Homo sapiens
tttaagaaagcgacaaactgtttactagattacctgtagaaaagtttacattcccaccagtaacatatgagtgatccagtttctctgcatcttcatcagcacttaatgttgtcactattttttattttagccattcttaggtagcaatatttcattgtagttttaacttgcatttcttttttttttttttttttaatttgagatggagtgcactccagcctgggcgacgagcgaaactccatctcaaaagaaaaaaaaaagaagttataatttagaagaatagtgacatggaaaatactcttgtgttattaggtaaaaactgtagaaaaatacagtgaaaatatatactgtgatattaacagtgagtttgtctaaaaatttttttatttgtgttttacaaatgatctacagtacacatatacttctaaagaataaaaatgttacttagt

SEQ ID NO: 257690 - DNA, 452 bp, Homo sapiens
gttcagaatggtattgcctaggttgtcttccagggtttttatacttttgggttctacatttaagtctttcatctatcttgagttaatttttgaatatggcagaagaaatggtccagtttttatctgctgcatatggctagccagttatcctggcattatttattgaataatattgaatattgaatttattgttttcattgatttcataaaagatcagatggtcataagtgtgtggccttatttctgggctctctattctgttccactggtctatttgtatttgtcgcagtatcatgctcttttgcttacagtagccctgtggtatagtttgaagttgagaaacatgaaaataatcttagttctaatctcaacattttcctgtgattttatttctctctgggcctcagttttcttatctgtacaatgagaagtgcactatgtcatgtagggtc

SEQ ID NO: 257691 - DNA, 177 bp, Homo sapiens
tgaggcctcttggagctcaggggtaagagtgtggagactgaattcgttctgtctgccatgggtgctgaaaggcgcatctcagctcctgcaccatctcagtcacgacctttatccctgtggccacatgcgtcaccctactgcatcctccaagcaacctgggcggcaggcagggcaaga

SEQ ID NO: 257692 - DNA, 690 bp, Homo sapiens
tctgggtatacatgcaaaagaaattaaatcactatcttgaagagataccagcaatctcatgttcactgaagcattattcataacagccaagacacagagtcaacctaagtgtccatcgacagataaatgaatatatatacttatatatgaatgcaaatgaatacatgttggaatacacacaagtggaatatttcccagccttagaagagaagggagtcctgccatttgcagcaacatgaatgaacctagaggacattctgctgagtgaaacaagccagtcataaaaagataaatgtcatatgatatcactgttaactcgtatctaaggcctgtctcaatcaatttaggaagcttattttgccaaggttaaggacacacctgtgacacagcctcaggaagtcctggggacatgagcccaaggtggtttgggtacagtttacttttatacattttagggagacatgaaacatcaatcaatatgtgtaagatgtatactcgttcagtccagaaaggtaggacaacttgaagtggggaggggttctaagttataggtagacaggaaacaaacagttgcattcttctgggattttgatgagcctttcagtgaatacacaacttacatgtgagagggggtagaggaattgtcatttaagccttagtctggctcagtgaatctggatttttacataa

SEQ ID NO: 257693 - DNA, 280 bp, Homo sapiens
gtgggttgtgcctgtagtcccagctactcaggaggctgaggtggaggatcacttgagtctgggaggttgaggctccagtgaaccatgattgaaccactgcactccagcctgggcaacagagcaagaccctgtctcttaaaaagtaaacagaaacaaaaaaataaataaaaacactttggtcatacaatccagtttgttgatttacaaatcaaatggtaccagtatctgccaatgccctgcctggtacaaatacaaatttttttccagacagttgttatgc

SEQ ID NO: 257694 - DNA, 214 bp, Homo sapiens
tactgctgcaaagtggcagagccaaaacacaaacctgatcttctaagtccaatgcacacctcacttagcacttacaaagtgaacttactacggtttcatcttgggacttctcaagactgaactattagactaaatgcatctactgtgaactccctgagttgggggcggggggtccatgtcttattccctctatatctccagcacacagacagca

SEQ ID NO: 257695 - DNA, 907 bp, Homo sapiens
aaaaataatataaaagaacaacatatttcatagtaaagcatccaattatagtttactcagaattgagagcagaaatggagagggggaaatatattttctgtagaattaccatgccatgaaatactatatatttattagacaggactgacaaatttgtctttaagcttcattgtagcaaaagctaatatggaaactggttaggtacaatacttacagtgcctgtattgtaaaaaacaaaaacaaaactattgcctaagagtaagaactatcatgatactgacaatgtaagtcttctgttgtctattgtctaatgcctttagagacattctcaacactcctgaaacaaacacaatgataaatctcattggctgcttgttaaagctccctttaaatattacatgtagagtatcagtgctaagtataaggaaaaaataaaccttgagtatagatgtggcttctacagaatatcagtgctaaatagaagaaaaaaattaatcttgagtacagacatttcttctacagtaagaaaattggaatgacctaactagtcaaatgtttcccttacaatgatattagggagttcaaagctaatttttttatcctcttatagtaaccattatatgtttgcttttaagtaccatattgtctgttggaaattttgacatttttttttgtttcactttcccatcattattacgtgttgttctgagtggtttgtatgatcaacagttgaaaccaaagagctggagtaggatgtgaagaagaggacaaaaacccctgggcagagacacaccaaattcaaggtaccctgggaaaactgcagtagtacttacagaaaaacgtgcttgggtcaaattaaaaaaggatgaatgtatagtatctcactggattaaaagaatacaatgta

SEQ ID NO: 257696 - DNA, 329 bp, Homo sapiens
aaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccac

SEQ ID NO: 257697 - DNA, 218 bp, Homo sapiens
ttcctttttttatggttccgaggattaggaaagtaacaacgtatactttctctgtcatggtttctgtactccagatagactggtagccaacgcaattggaggcagagaaacccattagaggcctctgcaatactgcaggtgttcagagcttcggtatgtctaagtaaaagttattttaaaaaaagagaattaataaaagttgttggttcaaagtaatt

SEQ ID NO: 257698 - DNA, 165 bp, Homo sapiens
cagaccacaaagcaaaacccaccaactctctgccaatactctagagggacacctaagacaaaaattcagaaaggctaaaggctacccataaagacgtgcatggaggggtacaagctatgaagccaaattagacgaggaagcaagttacagtcttgatgtgtgaca

SEQ ID NO: 257699 - DNA, 349 bp, Homo sapiens
gcctggctaacttttgtatttttttgtagaaacggggtttcaccatgttggccagactggtcttgaactacggacctcaagtgatccgcccaccttggcctcccaaagtgctgggattataggcgtgagccaccattcctggccctctcattctctttagaatggcctttgctacccccatggggatgcctagcttctccaatagccttcacctggtctttcttcctcctctctttattcctcctctttctttctctccttctctctctctctctctctctctcaaggtcttgctctgtcacccaggctggagtgcagtggtatcacagctcactgccacctcgaactc

SEQ ID NO: 257700 - DNA, 678 bp, Homo sapiens
ctcttatttaggtgagctcacatttctgaacttggaatgaggcaatatgaggattcaggtatgtcctggaaaagctgttccctaaatgtcagggagagagaagggagtatttgacttttaagtacagtagaaaacaagcaaatgatataaatggctaatttatagaagacaaaataaaaacgaataatagacattttagaatattcaaacttaccatggatcagggaaatgtacatttaaatgagatactatttttcacccatgaaaaagattgacaaaaagtttaaagtttcataatattcaaatactgacagagtgtggggcagggcacttctgccctgtagtgggagtgtaaatgagatggaatttgtggtgggctatttaacactactatccaaagcttaaatatatgtgcccttcaacccaactcttgcatttctgggagtctaccctgcagaaataagtgcacaagagtccactgacaaggatgtgttcggagtattggtaagaccacaaagaacacccaaattccccgaatcagggaagcgtttaaataatcaatggtgccttctttagaacatttggaccaatttaaaggagtgagggtagactgccttggaatagcagtattttgttgagggggaggatgccattttatgtcattttccttctttgcct

SEQ ID NO: 257701 - DNA, 417 bp, Homo sapiens
gcgaatatcctttctctccacatcatacccttcatcctgactgcctcactgtcttatgcattcaaatatgtatatttatgtatcatgtctgtgtgtatacaggcatacctcattttattgtactttactctactgtgctttggagatatcgcattttttacagactataggtttgtggcaaccctgcattgagcaagtctgttggtgctgtttttctaatagcatgtgcttactttgtgtctctgtggcacattttggtagttttcacaatatttcaggctttttcatgattgtcgttttttatggtgatctgtgatcagtgatccttgatgatattattgtcgttgttttgggacaccatgaaccacacccatattgatgttgaacttaatcaataaatgtgtgtgttctcattgc

SEQ ID NO: 257702 - DNA, 451 bp, Homo sapiens
ctcatttctcagaagtttctacttttaatcaaataagggaagtcccaaggaagcttctttctgcatctgttccatctcaaatgtcttcagcttaaaataatctttatactaactccagtgttctgagtgggaccccacaattgtatatttaatcaccttgtgaaacttgacaagtatttaacccaacattttctgatttggaatattttagagaatgtgattcattaataaatcatttatcaaaaaaagagatcattggtttgacagtgctgggcttacaggcatgggccaccatgcccggccagcagtatgtattttagttgactggcaaacagacaattgttcccttttttccttttttaaatttcaagccttgtcactgtgtcataagacaattgttcatgatgtcataaatgtaatttttacttcaataaactataatacacttgta

SEQ ID NO: 257703 - DNA, 785 bp, Homo sapiens
gttgtggagctgtgtcttacagacgaagaaacgggatcagagggataaaggaatctgccccagattacccacgtagggaagggtggcgcaggaacccggacctccatgatgtgaatgagccctttgacagcctttttcttctccttacctgtaccccaaacctctgcacctttaccccagttcctccttgctctggtgtaaacagtggtaacggtcccacttgcggcgtgcccccgcaatgctgggtcctgttccacatgacagaccactgtagaggaattatacggaccattttacagatgagaacacaaggctcggagaggtcaagttacttgctgcagaactgggacttgtacccaggtgacttgactctacagcagagcctttcaattactcgacaccaccttccccagaaaaagaggaaggcttccgaatgttgacagtggacgatacaccctcccttctctctccgacagggtcgccatcaaacccagttgaagagggtccagtgagagcctattagaggcttcacaactcacttgccagcagcagatttctcccatcgcttagagactgctcactcacaccactcctcagaagacctccagcaacatacacagccaggaacgacaggaaggaagggacatgacatttactgaacggcagtgctgaaccaggcactgagccagggcctgttactaagggcaaagctgggagggatattaccagcccaggtttgcagacgaaaaagcggattttttttttttttttgagatagggcctca

SEQ ID NO: 257704 - DNA, 1198 bp, Homo sapiens
ggctagaatgacaggctgtatgtgagatacatgaatctgtgaggaaaatgcacttagcatgtcatgggaccctgaggtcctggttctattccatgcttcctgcactgagaggtacttggttggaggcaggcaatctgaatgctctccccaacatccggtcagttctcatttatcttggtctttcattttccctcacccatttttttgtttctccctttcagtttgcaaaccattctccttgggagagaataccatttaaggtagtttcttttgctatttgttttatttcttaatcttctttattctctgtgcacatgcaaagcccccttttttggctagagtcattgcttcaagctgcagctcccttgggcttttttttcctgacttcattctgtatttgctcctggtaataatctcattttgtaattttgctctttagtcacagggcttcatttgggacactcacatttttgttctctttgtgattatttgtgattaaggagttgaggttatgactttaaggtgcttttgattccagagccatgtgccatataatcatctgtggtttgtgggaatgtctttgccgtgatctctctgaagtctgtgggcacattccagaccgtgctggtcttctgtccgcaggcttcatgcagagaatgaagtgtccttgctttctctttcctaaatgagtctctgcctctgtgagaactgggtccaccttctctcggttgctcttctttgtgggagcctgaatggtaagcatggccagcgtcctgtgaggagttgtagccaaatgagcagaagctgagcagctgtctgggtgggtgcggcctctgcatgctgcttccgcggccgcgctgcctccacctggccggggtccctcagctactcacatgaggctccagcatccggccctgctgccctttaacctcaactgtagcctctccagcgtggtcaccaattttttaacctaagggttcatgttcttgacaagtacacagtttattcattttctatccgttctcttttatattccaaatacctctccatctccatgttcaaatatttcaatcccgtcccaccagttcctggtaggatccatcactgtgtctatgaacacgaagataccgattagactggatgcaggtgctggtgtttctggttctgcagcgtgagtggccacattgcaaacatagcc

SEQ ID NO: 257705 - DNA, 355 bp, Homo sapiens
tgcccactctcacccttcctcctttcccggcccattctctctccccactgggtctccgacacgaccctctctcctcccggctgtccccgagcccctctctgcttccccagctcagccccctctctgacggcttctccctcccacccccaggcgaatctccgggctcccacggggtgcccccgatccccggggtctaggtcaaccgacaaaattattttaaatgggaagatttgaattccattgaattcatggaagcaggaatccatctggtcatattttaaataattttgaaatgataatagcaattatcaatttaaagtttaaccagaattcagaataaccaccattttaccag

SEQ ID NO: 257706 - DNA, 540 bp, Homo sapiens
gtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactgtatgtattttccagtatatactgctagctgtgtgatgttgggaaaatttgttaccctgtctaacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactga

SEQ ID NO: 257707 - DNA, 293 bp, Homo sapiens
gcctactactactaaattcgcggccgcgtcgacacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactga

SEQ ID NO: 257708 - DNA, 425 bp, Homo sapiens
gccagtggtggtgggggaagaaacatctcatatatagaggattaaagataaaaataatatcaaacttattcgcaaaaagtatgtatgcaaagagagactagtgcattatttaaaaaagtgttgatagaacaaaaccactggcctagaattctgtactatgcaaaattatctatcaaagtggaaggacaaataaaggctttctcagacaaaaattgagagaatttgttgccagtaaacctgttctgcaggagatattagaagtccttcagagagaggaaaaatggaaaagtttagaaggttggatctatatcaagaaaagaagaacattagagaaggagtaacttagaaaaaataaaatgttttatttttcttattctaactgatctaacagataaccatcgctcaaataatagcaaccatatatt

SEQ ID NO: 257709 - DNA, 415 bp, Homo sapiens
ttgagggaaacccaggctttgaaaagcaactcagtggtaaggcttttcaaattttatgagaatctctgcgtcagcaggtctggacaaatgcaaaatataaagcgtctgtgttggacttcagttttcccatctgtattgtcagaactccttttttattcccacccatttttcccccatcatagcttcttgagacagatatcaggaagggatctaatacaagaattagaaaatttttatgttttttggaggtgggagggaggccaggtcttactctgtcgcccaggctgaagtgcagtggcacaatcacagctcactacagccttgacctcccaggccaacaagcctggcctgcttttacatttttaaaagaagacttcaaaaggagtgcttagtgaaaaagtctcactgggacttt

SEQ ID NO: 257710 - DNA, 886 bp, Homo sapiens
tttttcatttcatctgcacgtcttttctcattgtggatttcgttggtctttgggctgttgctgtatgtgagtgcctctcaccacagatcttttgcttgccagggattttagggatctcaagggtttttcagtagtttggctgcactccaggttgtgggtagtcgtctcattttggggggccggattttttgcactttacaggagtctcttgggtttctggcaagaatccatgaacatgggtttgactccagcacaaaccctctcattctcccatttgagcctttatttccctttgctttcatgggggatccacagtgcccctcaacagcactcctgggcacccgtttcagtcttgcaatcaccccagacggtttctgaaactctctctcaaccttatgtgtccttgttggatgccagttccaggtgtgagacctcttctccgtcttggacttgcctttattgtcgttcctgccttacccagacagccgcgctgagaagcaggactccctggggggccctggatgaacggaggcagtgagctcaaaggcctcacagtcttccactgacaccctcctctggggtctcaggtatgattccatcacccggagatccctcaacaactcaccagactgtattcccttctccctgggaccggattcttgcacacagactctttcgggaatggagtccaaagagaagttcccagcgcccacctcacattctcgaatcgccttttcctccagcgggacccgactaatgagacggcccgaggatgccctatggtagttacttttaggcttccacagtgattgtcgcaggcagcattttccctagactaggccggctctgccttcccattttcctctgctcaggcaggctgacagcc

SEQ ID NO: 257711 - DNA, 422 bp, Homo sapiens
taggttcacgctgtcacacctaagaatgagcaggtgagaagatgctgctcggttcttgccttaaagcgggatgatcctgccatcttggagaagacccaggctggtgtttgctcctttaagcgactgggactcccaaatctgcagactttctagcatcctgcagggtggccatggtctagttgagcagccagaaagaagctcatcaattggaatggagtttgtctcctgtttctagtttcttcatccagagcggaatttttcaagatgtggtccaaggacgacctgagtcagactcaccccaggtctaggtgaatgtccacaaccactgaagcagaatcttcatggggtagattctaaacaaaacctacatttggaagaagctccttaagaattattctgcataataaaacatataaaacaga

SEQ ID NO: 257712 - DNA, 369 bp, Homo sapiens
cctgtggcatctggcttgctggcttttgccctttccttagggatctgtctggcacccaccatggctctggctctggactcatacccctcttttcataaaccctaactgcatggaaagcatgttgtaaacatgctcatgtagaaatggaaacaactcgagaatttgtatactggccttccctggtgattaatttcaattggcaataaaagccacaacctaaaggaactgaatgtttgaggaattcaaagagtcatttctatgggggcatgtgtgtgtgtacatgcacacatgtctatgaattaagttatacacagactttgaatttcacggccagatgaccagattcttctcaaatctgaaaaaaaaata

SEQ ID NO: 257713 - DNA, 96 bp, Homo sapiens
catctctgtaaattattaggagtggaagtttccagaaatatttagtgcagcagcattgaaacgtccgcctgcatcacgtggccccctcggtggaga

SEQ ID NO: 257714 - DNA, 213 bp, Homo sapiens
acattttaaaaattagaaaaatccctttattcttctaagaaaactgttagaaaaaaaattttagagcaggagaaatattttttaaaaaacatacctgacaaaggacatgtatctagactacataaagaacttctacaactcagttataagacaatctaattaaaaataggttaaatattttaacagacacttactcagaaaagatatgcaagt

SEQ ID NO: 257715 - DNA, 405 bp, Homo sapiens
gctagcgtgatttttctgcagtgtaaaccgccaacccatccctttgcataaacagccttcaatgactcttcatcacctttgcagttgagacctgtggaatctttcttctgaaaaaatccatatgcatgccaaggttggcatgattttcaagttaagaaattttgaaccatgagatatagtctgaactcagcattattatggcatagaaagacctttgaagtcctgtccctgcctaccttgccatcatcagcacccatccactactatcatttcactctgttttgcagctacgttgaattaattacagagtagttaaaagtgtggcttctgcctgggctgactccagctataccacttatacttctggatgtgtgtttttttaagttctgtgcctccgtttgctca

SEQ ID NO: 257716 - DNA, 399 bp, Homo sapiens
aaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccaggcattgtgtgaggtactcacctcatttgtatcttgtttgtcctcataggcttgtagttctatatccaaaaatctatttatactaattttaaaacactcaatttttatatcatattgtacctaagtgactttatgtatagaaataaattgatatttactgaaatt

SEQ ID NO: 257717 - DNA, 402 bp, Homo sapiens
cattcccccagatcacctcaacaagaatgtttactaggttttttcctctccctccaagattcagcaaacactgtttccagcagaggcgtttccaacaatgtatgacagcgacatctgcgtgggcctggaggcgctgcgcccgagggggctttcgtgcagccagacacatttcctactctggagctgattctgtcatgggggcctccagatttgtcaggcgcccttggcgagcgcaggggagcccctctgttcctgcttctagggcatcagtgaacatctcttttggccagagggaccctgcggggtgctggggtgccacggtgaccaaggcagaccccatcacaccctcaccgagctcctggtttggacaacaaaatgcagagacaaattaatctataaaaa

SEQ ID NO: 257718 - DNA, 453 bp, Homo sapiens
ttaaatgtaaaatatcttccaatttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggcgtcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctca

SEQ ID NO: 257719 - DNA, 428 bp, Homo sapiens
tggcccagggaagccaaaagattggacacccctgatctataccttgctgggtcccagcagtgtattttccttatgtaggtacaaggacggtgcttctggatcctggcagaaaagaatgatgctaaggttactaaaatgtcttcctggctgggcgcggtggctcacgcctgtaatcccagcactttgggaggccaaggtgggtggatcacgaggtcaggagatcaagaccatcctagctaacacggtgaaacactgtctctactaaaaatacaaaaaattagctgggcgtggtagtgggcacctgtagtcccagctactcgggaggctgaagcaggagaatggcgtgaacccaggaggcagagcttgcagtgagccgagattgcaccactgcactccagcctgggtgactgagtgagactctgtcttaa

SEQ ID NO: 257720 - DNA, 309 bp, Homo sapiens
tctataaatgtttcttttatgtgtaattatctggatctatattaagctaaacatgagatctttctgatgtctccaattctaatccattgccaaaggatcattaataatccatatggatcgttcaaacttcctttctctacttatctgtaacctctcaactgcaacagtgagaaacctggcttcagttatctgccatccatttacttattgttcaatttcagtacacatgtacagcagtatcagaactgttaacctatgcctcatgggaaataactttgttaaataaaatcaagagcttatgtaaagttt

SEQ ID NO: 257721 - DNA, 338 bp, Homo sapiens
agaaatcttaagaattagaagtgattactagagagtaattctaggtttacccagcctcagacaggtgctctaattaactattctcattcttcttctttttttctatctagttttcatgctttttcctcctctcatgcccttataattgaggtaaaatgctcagatgagcattgacaaatgtatacacccatgcaaccacaccccagtcaggatctagaacattccgtactcaattttgggggagctgtttttaaaaatgagtattattacagtcctctgctagtaggaatgaactcctctctaaataccaggaaaaaaataaaataaaactgaaggac

SEQ ID NO: 257722 - DNA, 191 bp, Homo sapiens
tgtgaaatctggcggttaataaaaatagcctgcttttttattagcttcatccaactacgggaacagaatagtttaacagtaactaagtatgcttcaaaaggtaactctctaaaagtaaaactgtaaatactagaaaatgtatcatactagaaaaggtataaagggaaacattttgttcattatccccccac

SEQ ID NO: 257723 - DNA, 560 bp, Homo sapiens
tgagagaggatctggctctgttgcccaggctggagtgcattggcatgaacatggctcactgcagcctcgaactcctgggctcaaacaatcctcccgcatagctggggctacaggagcactgccaccatgcctggcttttattttattttatttatttttagagacaaggtcttgctatgttgcctaggctggtcttgaactccttgggctcaagtaatcctcccacttcagcctcccaaagtgttgggattacaggcatgagccgccgctcccagtctctttactctttaaacatgtaaaactatcttcagctcgtggcttctacccacagaaccatccactcatgcactccccagggcactgtcctgcagaatcctgactgagtagtgctatgaattttcaaggaaacccttccggcatttggagaagcaccagggtgccctgaaaagcacacggctttaaaatcccactggcccacctgccaccattcagcttgcagatctgcagttcagagtttggggacctggcatttgtcactgccttggccttagtttcccaag

SEQ ID NO: 257724 - DNA, 640 bp, Homo sapiens
ctttttaaaactgttaaaattgctttatacacctacaataacaattattaattataagatactatttacatgtggttgtaaagaacacacttaaataacttacatatgtgaatttaaattataaatttatatttagcaacatagtgctacttcaaacaactataaaaattgatctatatattcctaaagaagagtaaagggccaaaacaggcaaaataatacagaaaaagaataaatgttagaaggcagttctccattggtctcttgtatttctgcacatcttctcagcagaggcattgacagatttgtgtgtgtgtgtgtgtttctgtactatttttcaatgatgtttttacagaaaacagcttgggaaggtagaagtagtgtctctcctccagggcaatggcagatttgtttgttgtccaggataatgaagaaatgtcttcctcttggataaaggatcggcagatttgctagcaagtgtggggtttcctaaacttgagttcttcactgtgatgcatatagcatcctcttagcccttccatgtcacacataggacttgggtgcaagggtaaatgaggtgaacatgaagcttatactaactgctgtactctgagcaataaaatcatttgcctctgactca

SEQ ID NO: 257725 - DNA, 460 bp, Homo sapiens
caaacttaatgaagaaagtttgctggagttgagagtcagatcacattttttggcaaaacaggaaaacactcccaaactctgaccatatatctgctctagttttttgttggaaaaatgaggtgatgatggaccccttccacacttgtgaaggatatgtgtcatgtaattaacctgggaaaatgcagctcatcaatttggggttcaagggtaaaagagaggtgagacacagttttacagggcttggagatttttttttaggggattttttgtggagagtctagaacttctctaagaatttaagaggtattaggattttgcactttaaatatatttagtgtttgcttcataagtttaaatattcaacaacttttaaaattccttaatttcaccatacagaatatagatttaatttcatctaaaatgaaattattgcttaaatggcttatgtattagttaaaaa

SEQ ID NO: 257726 - DNA, 250 bp, Homo sapiens
atgtgtaaaaactatcaagttggcttagctcagttgtgctaaaaaaaaaaaaaaaaaaaaaaaggtgggtttaaaatttcaaagatcaatagtgtaattagtacattcacagattaaaggagaaaaaccatataatcaactcaatatgaagcaggaatagtgttttataaaatacaacattaattcatgatttaaaaaactctcgaaaaattagaaatagataagaatttatctatcctaatgaaagata

SEQ ID NO: 257727 - DNA, 285 bp, Homo sapiens
tgtttttttttgtacttatatgtagaaagtactagaagcttattgtgtagttcaggttgttctcagttccaaagcatcgagatagagcagacagtttagcttatgatacttccttatcactacattaacttccgagaataataaagcctgttttcactaatagcaaaattttttaatgaggcccaaagatgtcagctgccttcccgtaacagtctcggcagtcaatttctttctgcatttggtgtcgacgcggccgcgaatttagtagtagtagtaggcggccgc

SEQ ID NO: 257728 - DNA, 509 bp, Homo sapiens
tgcattccaatgattagaaacctgcaacagcaaaccaaaatgagacaagttcaaaatcagtgattcttggcctttatcccacctcccttaaagaagggatattttggactcatagttactacatgattaatcacttggttgctttttggtgttatctaaatagaatttcccccacccccaacacacacacaccaaattgatatactaagcatccaatcacatagttggaggaaatggtgccatgagttccatgatagatatctccaaaagaaaagtttcatcttcagttacagtgacattaaaaattggcagcatatctgcaaaggtggtaatccccccagctccccaaggaccatggcacacaggctaagaaccagcagcttctgttccaggcactgtgcctgatactgggaatgtggattcagtccaagtcctcttaaagcccatccagcaaggggcactgacaagtaatcaggcagtttttcaagaattcattcacacacaagaaa

SEQ ID NO: 257729 - DNA, 676 bp, Homo sapiens
ccagatataaattctatcctgtcgtagagggcagtgtaaatgtaatatatgtaaagtttatattatttctttttttgaggtcaataagatgtggtacacagtatattcatattagaaacaagccttgatgcaaaaacataaagtcaagctttcagttttttcttggcatggatgaggaaagaggcgataaaaattaaactaaaatgtatcccacagcaaagtacagcatttcaaagtgacatatgtttaataaacaaacacagatgattttacagtgagcataaaagtttacattgtaaagactctttttataaatagcacacacaaaacacttcactataaattaaatccatgcaggcaacatttctgaaaaatgaaatatttctaaataacttactgaaatggcatgtttaacttttattttttaatcttatgttgaaaatattagaaactaacattttctcaaattattttcctccatatacagaataggagagaaatctatagaaaaaatatacaaagaaaatcttacaaaatataaagaaagtcatatatcaaaagtgagaatacattttttctcatcacccaattctgcctaaaaactgaaattagcctgtttcttcatattcttaaaagcaaacacatatttctttaaaaagcaatgagtagtttatcc

SEQ ID NO: 257730 - DNA, 1030 bp, Homo sapiens
caccgcactccagcctgattgacagagcaagaccctgtctcaaaaaaaaaaaagaattcctaaagtccctggaaacacagaaatccccaaaagatttcagctttcctccttaattctaagaataaaaagcaacagtgatgctgagcttaacgcaacacgagaacagcaagagaaaataaaactgcttccacgaccatcaccaagcatccaagtacgagaggaagtgaatctgagctggagccatggcagcgcccggccgagccagggaggagcagacaggcagggcagctggcccttttcacacagtaacaagccccatgctcgctcacacacagagtgccacagaaaacgaacgcctgccctcgtgagtcacaaagttaatgtcaagaagcaacaagaccagcggccacacctgaggaaggatcaactgcctcaacccatagctgccaccctgcccagaaccacggtttcctgaaactataaaaccattccaaaggtatgattagctacagagaaacaaaaccaaaccccacatgctgaagcccttttaattcacagactcatctactgccccaggtcctaatagagcattcagtgaatgtttgctgcattaattttattggtattgacttgggtctggaaacctaataaagattttttttcttgtaaactgatgcttagaatacagtaattcaaaaagaaaagcagatcagaagttgaacaaaataactccagatatacatttgaatacaaagaattgaacaggccgggcatggtggctcaggcctataatcccagtactttgggaggccaaggcaggcggatcatgaggtcaggagatagaccagcctggccaacatggtgaacccccgtctctactaaaaatacaaaaattagccgggtgtggtggcgggcacctgtagtcccagctacttgggaggctgaggcaggagaatcgcttgaacctgggaggcagaggttgcactgagccgagatcataccatggcactccagcctgggcgacagagtc

SEQ ID NO: 257731 - DNA, 559 bp, Homo sapiens
tccccaattttacttgaaaaatgtataaaaatatagctaatgggaatgctttaggtggaatattaaattcttctgaatacagctaaaaactctgaaagattctgattgcctgatccatactgtagtgatcatagaaccttccctgaggaattgtgaatttgagagaatcttcttattatggctatgatcagagatccctaaagaatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggacgtgaagactgagtattccatccccagacaatgcaatttcagttatctgagtttttaatcctgactgggatgagagaaggctgagtgatagaagtatctgaatatgtggtattattcctcctgcaactcagggaagaacagagaaactggcaaagtgaacatcctattt

SEQ ID NO: 257732 - DNA, 1884 bp, Homo sapiens
atgattggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccaggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaaggaa

SEQ ID NO: 257733 - DNA, 1810 bp, Homo sapiens
atgattggccgaggctcaagagagcgtggcgtcgcattgccgtttttgctcagaatcgcgactaaggctttttttttttctccctctgaacggttaggctatggctgcgataaaggccgtcaactccaaggctgaggtggcgcgggcccaggcagctttggctgtcaatatatgcgccgcccgagggctgcaggatgtgctgcggaccaacttgggtcctaaaggcaccatgaaaatgcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtct

SEQ ID NO: 257734 - DNA, 1774 bp, Homo sapiens
ggctgcctgtggctctgttgccctcctctgtgcgccggcaggatcttttgtggggcttcgttgccctgctctggggcccaggcgggtgctggtccacattcccaggtccccaacagccttcaaagatgggtaaaggagctgcccgtcgcactgtcgactcacagatggcaagtgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaaggaa

SEQ ID NO: 257735 - DNA, 1813 bp, Homo sapiens
gtccgcgtagcgctgtggatgttcttgcgagcttgatttccctcattctcatccctgctctgggggtatttctcgcctggtgcaggtggaggagaaaagcctcccctagtagagggccccgggagtgaagctgtggcgcttccccgacccccgacttgtcgtcaaggcttgtttctggtgcaggtgacatcaaactcaccaaagatggcaatgtgctgctcgatgagatgcaaattcaacatccaacagcttccttgatagcaaaagtagcaacagctcaggatgacgtcacaggagatggtactacttcaaatgttctaattattggagagttattaaaacaagctgacctgtacatttctgagggcctgcaccctagaataatagctgaaggatttgaagctgcaaagataaaagcacttgaagttttggaggaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaaggaa

SEQ ID NO: 257736 - DNA, 1488 bp, Homo sapiens
ggacgcaggcgggaagtgatcaaggctccctgagtcccacccgagcgctcccggttcagcgcaggaggacgcacgccgggccaggggcctgcaccctagaataatagctgaagttaaagtgacaaaggagatgaaaagaaaaatcctcttagatgtagctagaacatcattacaaactaaagttcatgctgaactggctgatgtcttaacagaggttgtggtggattctgttttggctgttagaagaccaggttaccctattgatctcttcatggtagaaataatggagatgaagcataaattaggaacagatacaaagttgatccaaggattagttttggatcatggtgcccgtcatccagatatgaagaagcgagtagaagatgcatttatccttatttgcaacgtttcactggaatatgaaaaaacagaggtgaactctgctttcttttataagactgcagaagagaaagagaaattggtaaaagctgaaagaaaatttattgaagatagagtacaaaaaataatagacctgaaggacaaagtctgtgctcagtcaaataaaggatttgtcgtcattaatcaaaagggaattgatccattttccttagattctcttgcaaaacatggaatagtagctcttcgcagagcaaaaagaagaaatatggaaagactctctcttgcttgtggtggaatggccgtgaattcttttgaagatctcactgtagattgcttgggacatgctggtcttgtgtatgagtatacattaggtgaagaaaagttcacttttattgaggagtgtgttaacccttgctctgttaccttgttggttaaaggaccaaataagcatactctcacacaagtcaaggatgccataagagatggacttcgtgctatcaaaaatgccattgaagatggttgtatggttcctggagctggtgcaattgaagtggcaatggctgaagctcttgttacatataagaacagtataaaaggaagagctcgtcttggagtccaagcttttgctgatgccttactcattattcccaaggttcttgctcagaatgctggttatgacccacaggaaacattagtaaaagttcaggctgagcatgtcgagtcaaaacaacttgtgggcgtagatttgaatacaggtgagccaatggtagcagcagatgcaggagtttgggataattattgtgtaaaaaaacaacttcttcactcttgcacagtgattgccaccaacattctcctggttgatgaaattatgcgagctgggatgtcttctctcaaatgatgattgaattcaaaatcaacccttctagaagatgaaatttagtacactttacatctgactactattgtgtagcctgagccattctgaatttctacacaataaatgcagtttatgtcttttgggtcttaatagtctcaaaaatatttcatcaaggtataaagaacacaataaatacttttacagtaaaggaa

SEQ ID NO: 257737 - DNA, 238 bp, Homo sapiens
attagaagatccttgtggaacaggaagcagagtggggcaagacaagagagagcatatacccaggggaggagacaagctagggtatcatatctgcttgatggggtgtcagccctgagcagagaaggggatccggaaggagtatgtgggctggaagaaaaaaggaccagggttcctgcagaacttacagaagacacacattgtgtccattttgctcattgcaaccaaatgattaactttg

SEQ ID NO: 257738 - DNA, 308 bp, Homo sapiens
cagcaggaggcctggagtcagccctagctctgtgttggtgtccctctgaccctaagaaagacccccactcttctctgggtctcagttcccatctgtaaagtgagggaaccaggcgagatgattcccaagaatccttccagcctgctgctcagtgatttctgtacatttaaacggctcaggcttagctgacagccactctcctgcctaaggtccccaaggaagcccagcctgtgatggtgcaaattgctctgccttacctgactttgcctgaccttgggcaaataagaaacactctgtctgagcctcca

SEQ ID NO: 257739 - DNA, 429 bp, Homo sapiens
caatgctgttggatataaagactgggtccttggggctgttaggaaattgtgaaataatttgaaataggaggaacaaggttagtaggtgtcctggtattgaagaaagaagggtggggcacaggtgtccagtgtgtctttgccatcagaatgttcttccaccttcaccgcattttgaccactctgtaaattgttgaaaactgataataatgtaaatgattcttatccacagaaatgcaagtaaatctggtgaaatgcactgattgttgtcttgcaaatacaccttttctgcatttcagaattccttattccctttgtgtgtgtatgtgcctgtgtatggctcttggaattctccttgaacccattttaacatctttttggtttacttattcattagtgaattaaataaaagttattcgcaggtaccatttt

SEQ ID NO: 257740 - DNA, 608 bp, Homo sapiens
ttgtcaggaggattcgacgttcagtgcccagggatgtggaggtgatggggggccggggaggagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtgggtaaggacaaccatcctgtgaagttgtgaggagcctgttatgggttaaattgtgcccccaaataaaatatgttgaagtcctaat

SEQ ID NO: 257741 - DNA, 651 bp, Homo sapiens
ttgtcaggaggattcgacgttcagtgcccagggatgtggaggtgatggggggccggggaggagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgaggtatcagtgtcatttgaggatgtgactgtggacttcagtagagaggagtggcagcaactggactctactcaaagacgcctgtaccaggatgtaatgttggagaactacagccacctgctctcagtggggttcgaagttcctaaaccagaggtcatcttcaagttggagcaaggagaggggccatggacattggaaggggaagccccacatcagagctgttcagggatttccacatatttcgtcacatccacagt

SEQ ID NO: 257742 - DNA, 731 bp, Homo sapiens
ttgtcaggaggattcgacgttcagtgcccagggatgtggaggtgatggggggccggggaggagtctcactctgtcacccaggctggagtgcagtttgtgtgatctcaactcactgcaacctctgcctcctgggttcaagcgattctcctgcctcagcctcccgagtagctggaattacagagttcttggagtctctgcggagtccctgggccagatctcacagtgaaagctgcaggatcttccttctgaccccagcagtccccgttgagtccaccgatcccactggaattataaagttgtcagcaagaaagccccagggctgaagtccaagtccgtcgggaacatgccagctaacgaggacgctccccagccaggggaacatggcagtgcctgtgagaacacctgttgaagtctgcaaaagatgtggtttggagagcttcaggattggtgaacatggaggtgctgggtggatggcacgcccggagaagacgtagaagctctgcgccccttcccacataccttgccctatgtatgtggataggggtgctaggaacatctgctgttctaacatttggtctttgacccttgttcttgacacagagctcctaatcccatgcagtttcctgggtgataggagcatcttttgttctaatcaggctgtttatctggctgttcatctgtgtcttttgtaatattctttataataaaccagtaaatgtaaataagtgttt

SEQ ID NO: 257743 - DNA, 567 bp, Homo sapiens
cgcccccgcccccgccccgcagggcccccaggccgggcgctgggggcgcacaggcatacagattctctctcctcaccacgcggctgctgctggaggatggaggaggggtggtgtcagcaattcaagactgtctttcctaccctcttcagtgcccttccttgataagctgtttaaaccagaaccgtactgtttctggaaaaggtaaacatctattctccaaagggcagtgactttctacctgtgaaaataaaaagtaaacttcagaagaaaattctgaaagaggaatttagagatgttccaaataaaggcaatatagtttcactggaactgaaatgttgccttccaattctactacagaaggcagagtggcacatgtggcacctggtcaggatggactcactaaaggatttaacccagacttctgatcaacaaatattgctgctacattaactgattcgcaacaaagaaagaaaatatcatccagttgattttattatttaaatatgggctcaaatcttaaatctgacaaactaataaataaatatgtctgaaaagtaaatagtaaat

SEQ ID NO: 257744 - DNA, 433 bp, Homo sapiens
agcaaagtacaaagaattggtaccatataggatgctgtacactgactactattagatgtcactaataaaaagataaataaccctcatacatacttttgagtaacttgtggatcaaagaaaaaatcatcatggaatgaaggaaatactcagaactgaataacagtgatgtttttggcaagtacctagagtgatcctcacaaggttcatgttacagtagaaagaaaggctgaaaacccaataagccaagtttcttacttaagaaatcagaaaagtaacaggagaataaacacaaagaaaatagaaaaaaatagtgaagatcagagaagaaaataaattttaaaatgacacactagagacccacagaccaccagttggttcagaacaggattgttctgaaaaaatgaggaatgtgaattcagacacagaagaaatt

SEQ ID NO: 257745 - DNA, 141 bp, Homo sapiens
actgcctataacataagccccgtgaaggcaggcatcttgcgcatcgttcattgcgtggcaccttgcccatgcatgatgaaaaactcagagatgcacgggtgttttcctgaaggcacctgccagtggaagccccctggctca

SEQ ID NO: 257746 - DNA, 271 bp, Homo sapiens
tgcctggcccatgctgctctcttgacagcaagtgctctctgtgtcccattcagatgtccccagagagtcctgccttgggtcatgcagccattgtattaaacaatgaggatccccgttctcattccacaccacctctcaggctgcggctgacgtctttgcaggcagctgccctttatgtagccccaagttgtccaatcagctgtgaccagggtggcagggtcatgtggtttaaaaaagcaaagcttgggtaacacagataccttgtctctac

SEQ ID NO: 257747 - DNA, 453 bp, Homo sapiens
gaagatattccatttacaatgaattcctcaaagagctccaaatatccacaagcagattctacaaaagcagtgttttaaaactgctctatcaatagaaaggttcaactctgttaattgaacacacacatccaaaggagtttctgagaatccttctgtctagtttttatttgaagatatttctttttccaccataggcaacaaagcgctccaagggaactcttgcagattctaaaaaaagcgtgtttctacactgttctatcaaaagaaagtttcaagtctgtgagttgaatgcacacatcccagtgaactttcggagaatgcatgggtctacttttcatgtgaagatacccgtttccaacgaattcttcaaaaagttccaaatatccacctgcagatactacaaaaggagtgtttaaatgctggtctatctaaagacagattcaactctcttag

SEQ ID NO: 257748 - DNA, 197 bp, Homo sapiens
tgcacacaaaaatagaaaaattagccacgtatggtggtgcgagcttgtagtttcagccatttgggagggtgagctgggaggattgcttgagccctggaggtcgaggctgcagtgagctgtgatggcaccactgtactgtcagagtgagaccctgtctcagcaaaaaaagaagaaggaaaaggagaaggagaagaaga

SEQ ID NO: 257749 - DNA, 499 bp, Homo sapiens
taggcctttactaagagaccttgtgggcagatggtctagagggacagtgagccccttagcgttgaacagtatgtgtattcaataatgcagctcctcgtggtattgattagtaatcatagccaactacttatgtagcacttaaatctcaccacaacaacatgaaatgggtatcattcttattattcttaatctatatttaaaagaggttaagtgacttctccagtgatatatagtttaccagtaataaagccaaaattagaattcattcagcttgatgtgaatctgtgttgttaaccaccacagcacactgcctttcagcaaaggctgattaaagctgcaccaagtctctaagtgtgtacagcccatcagaatctcgacactgtgtttgacaagcatgggacgtgcagttaaactggggaagaaatttctttctcatagaagagatccttgtgtgtgaaaattagaactatctgaataaattagaatcaacagaaattct

SEQ ID NO: 257750 - DNA, 650 bp, Homo sapiens
tctagtagagacagggttttaccatgttggtcaggctagtcttgaactcctgacctcaagtgacccacccgcctcagcctcccaaagtgctgggattacacgcatgagccactgcacctggctaacaagtgctattttttagttcccattatgtgccatggactgcacatcatatacatttttgctaatccttacaccaaccctacacaatagatatttttatcctaatgttagagataaggaaactgatgctcagagagcttaagtgacttacccaagatcacacagctagtaagtgacagagtgagaatcagatctgactgcactcaggtctgacggactccgaattgcctcctcttgccactgggcaatgggcctttgagttgttccctcacatgtctgtgaggccagaccctgagtctgagattctggggtcccctcagtgctgccagttccttagtccctaagactgttaagaccacagagcccatggccagtgaatccagcaggggaataaatatgcagatgatataagacagcaaaaatcagcccagggctgggactggaaggccctggtttacggaatgaaccccgtcttctttggagctacagcctccgtcctgctctgccttctctcggcttttatcccg

SEQ ID NO: 257751 - DNA, 633 bp, Homo sapiens
tctagtagagacagggttttaccatgttggtcaggctagtcttgaactcctgacctcaagtgacccacccgcctcagcctcccaaagtgctgggattacacgcatgagccactgcacctggctaacaagtgctattttttagttcccattatgtgccatggactgcacatcatatacatttttgctaatccttacaccaaccctacacaatagatatttttatcctaatgttagagataaggaaactgatgctcagagagcttaagtgacttacccaagatcacacagctagtaagtgacagagtgagaatcagatctgactgcactcaggtctgacggactccgaattgcctcctcttgccactgggcaatgggcctttgagttgttccctcacatgtctgtgaggccagaccctgagtctgagattctggggtcccctcagtgctgccagttccttagtccctaagactgttaagaccacagagcccatggccagtgaatccagcaggggaataaatatgcagatgatataagacagcaaaaatcagcccagggctgggactggaaggcctgagtgaggaaaggaacctgctctctaggagtcaggacaccccggtcctggccctgactca

SEQ ID NO: 257752 - DNA, 357 bp, Homo sapiens
aggatccatctcaaaaaataaataaataaaaataaataaataaataaataaaagaggctccgtgcagcatttgggcctcttgctcttctgtcttcagccatttcaggacgcaatgtttcctctcagtaggacgcagcaacaaagtactatcctggaaggagagacagggcctctcaccagattctgaacctgcctgcaccttgatcttggacttcccagcctctataaatataagaaataaatttgcattctttataaattactcattctgtggtattgtttttatagcagcacaaacagactaagagaacaggtctctccttttcacatccgtgagaagtctctcaaattcctaga

SEQ ID NO: 257753 - DNA, 173 bp, Homo sapiens
gagaaggaaaaggcccaggagggaaagaggaagggtgggcagagatgggagattggccggcagagtgtggggctggcccctgcagaggagagcaggaaggcagagggctgggaggaagagggtttcactgtagggcagttttcttcttttttttctttttctttttttttttt

SEQ ID NO: 257754 - DNA, 431 bp, Homo sapiens
aatttgaaaagactgacatctttcagggtctgaccacctggaattataaatcagttaaaatctttttcacatctccaaataggtggaaactatataacatacttctaaataactcatgtgttaaagagaaaaacaaggaagcggggtgccgggggctcaggcccataatcccagcactttggaaggctgaggcaggtggatcacctgaggtcgggagtttgggaccagcctgaccaacatggagaaaccccatctctactaaaaatacaaaattagctgggcgtggtggtgcatgcctataatcccagctactcgggaggctgaggcaagagaattgcttgaacccgggaggcagaggttgcagtgagcagagatagtgccactgcactccagcctgggcaacaagagcgaaaccccatctcaaaaaaaaa

SEQ ID NO: 257755 - DNA, 431 bp, Homo sapiens
ggctttaccacaataaaacattataaaattaatcacagaaccaaaactctaaaaccattttttaaaattgtataaatttaaggagtgcaagtgcaattttgttacatgggtatatggggtaggagtgaagtctgagcttttagtgtgtttatcactggaacaatgtacactgtatccactaagtaatttctcatcaaccttccccctcccacccctcacccttctgagtctacagtgtcttatcattttacactctttgttcatgtttacgcattatttatttcccatttttaagtaagaacatgcagtatttgattttatgtttctgaattggaaaactataaaactcttagaataaaagataacaataaatctttatggcctgggatttggcaatagtttcttagatatggcaccaaaagcacagtgat

SEQ ID NO: 257756 - DNA, 344 bp, Homo sapiens
taagcctagatatcagagttaaaatctgttctcttagctggatccaagtatgagagtcatcatctcacctttgagctgtgaccatgtatgtgtcacaatacacctgtgggcaggaaccagacataagagtcatatcacctgggtgctgggctcaacttatagaaggcattgtgacagatctctgggttcatcacctaggagatgtgactctacactcccagctgggccaagccccactgaagattgtgacatattaatgagcccataaactatgtgacatgactctgctccctggcctaagccaagattaaaggggacattgagacataatgctttgcctagca

SEQ ID NO: 257757 - DNA, 378 bp, Homo sapiens
taggcttttaaaagcaggactagttgtgccctgccctcaggggtccctgattcagtaggtctggagtgggaccagcaaccttcttaggggatgctggtgctgctcttctggagccacactttcagaaccattgctgtaagatccacagatcatgataatgataatggtgatgagagatcatgccagtgacagtctttctcttcccttcttcattctgtctttacattggagctcagttactgtcttgaaagtgtggtctaaactttaatcctgctgccaacttttgatgactacttgtatctatagctcaaagtccaaattctttcatgtggtgcttgaagccatcttccacctttggaaggcactagtcattctcca

SEQ ID NO: 257758 - DNA, 604 bp, Homo sapiens
ctcacctggaaactcctcacacaattcagtgatggtttagcaatttcattataatcatgaaacaacagacaccatagcactagtttaatattaactttccttattatattttcattcatattactgtcatgcttttttgaaactgattattctgttttctacagcttcctaacaggttaggaaagcacacatggaagttagcactgtataattctttatttaaagcatataatttgatagcatgtgaaatttagatgacaattcttaagtaaaactaatcataaaaattatatctgacatttatttttatgtgcagattgtgtactcagatgttttacattagtgatttttttaagttatcacatcagccctaagaggaaggtattcctactttccttattctgtaggtaggaaatctgaggatttgacaacttgagttgtttgttaatgtgatactggcgggaagtaataaggctgaatctaaacctcttgagacagactccacagtccataaacttaccactaattaagaaggctggcaatttgggatataatttttttttgttctgataatcatagtaaatatttaccgagaatcagcatt

SEQ ID NO: 257759 - DNA, 162 bp, Homo sapiens
gctgagagctgggcctggctggctgtgggcttctacagagtagttgcagccctgtgcacaggcagggggggtgtcaccgactcgcatgtgggcaggtctttgctgcgcatcaggtgctttaagcttcggaacaactgtgcaggattctattttagtattctg

SEQ ID NO: 257760 - DNA, 462 bp, Homo sapiens
cctttgcgtgactgactctcttatctaccaccgctacaggctgaaggttgcactattggcttccctacttttgaggttttgggactccgactggcttcctggctcctcaccttgcagatggtctattgtgggacctcatcttgtgatcatgtctcagtatgttgctcagactggtcttgaactcctggcctcaagtgatcctcccacctcagcctcttgagtagctgggactacagttgcaagccatcctgtctggctagttatctttaattaatgacatttgttaaagtaacacaaaaatcctagaaacatttgcctgttgaaactttctgataatttgaatgaagtaaagtttggagtctctgtctcattgaaaatactcaaggttaatataataaaaacagcaaagcagtaatgcataaaagaattattagaagtctaataaaattatttggacctcca

SEQ ID NO: 257761 - DNA, 899 bp, Homo sapiens
caatgattgagtcagtcatgtgtatgtaataaggcctccataaaaaccgaagaggatggggtttgcagagcttctaggctggtgagcacttggatgtgctggaggcatccagagggtggagcacgtggagagggcatgaatgctcagtgcaccttccctcataccttgccttatacagcgtttccatctggctgctgttgagttttattctttataacaatatgctaaccctaagcaaagttttcctgagttctgtgagccattctagcaaatggtggaacctgagaaaggggacatgggaatctctgacttacagccagtcagcccgaagcacaggataccaaaatcatcataccagagacatgaatctccctcatttggcatcccaggaggcctggatcagtttcactgtgaatgctccgccgctcaaccacacaagcacccttcctccaggcccaggggatactgcagaagaggctgaaggttgcactattggcttccctacttttgaggttttgggactccgactggcttcctggctcctcaccttgcagatggtctattgtgggacctcatcttgtgatcatgtctcagtatgttgctcagactggtcttgaactcctggcctcaagtgatcctcccacctcagcctcttgagtagctgggactacagttgcaagccatcctgtctggctagttatctttaattaatgacatttgttaaagtaacacaaaaatcctagaaacatttgcctgttgaaactttctgataatttgaatgaagtaaagtttggagtctctgtctcattgaaaatactcaaggttaatataataaaaacagcaaagcagtaatgcataaaagaattattagaagtctaataaaattatttggacctcca

SEQ ID NO: 257762 - DNA, 1222 bp, Homo sapiens
caatgattgagtcagtcatgtgtatgtaataaggcctccataaaaaccgaagaggatggggtttgcagagcttctaggctggtgagcacttggatgtgctggaggcatccagagggtggagcacgtggagagggcatgaatgctcagtgcaccttccctcataccttgccttatacagcgtttccatctggctgctgttgagttttattctttataacaatatgctaaccctaagcaaagttttcctgagttctgtgagccattctagcaaatggtggaacctgagaaaggggacatgggaatctctgacttacagccagtcagcccgaagcacaggataccaaaatcatcataccagagacatgaatctccctcatttggcatcccaggaggcctggatcagtttcactgtgaatgctccgccgctcaaccacacaagcacccttcctccaggcccaggggatactgcagaagaggctgaaggttgcactattggcttccctacttttgaggttttgggactccgactggcttcctggctcctcaccttgcagatggtctattgtgggacctcatcttgtgatcatgtctcagtatgttgctcagactggtcttgaactcctggcctcaagtgatcctcccacctcagcctcttgagtagctgggactacagttgcaagccatcctgtctggctagttatctttaattaatgacatttgttaaagtaacacaaaaatcctagaaacatttgcctgttgaaactttctgataatttgaatgaagtaaagtttggagtctctgtctcattgaaaatactcaaggttaatataataaaaacagcaaagcagtaatgcataaaagaattattagaagtctaataaaattatttggacctccaactatagcaacactgattaatgactgctttttaattaattggaagttgttcaatcatcgtgccatttcatttcacctgagagtttttataaaagggtcagagccaaaacatatgctagttcaatttgcaataaggtatacttaagcaatttcattcttcttggcagggcaagtgtgggctattcatttctcatttattcacggtgatgatattccctgttcagctggctagtgtgatcaaggaagacagtcttaggcattagaatatgaataaagtttacttttaagctgtgcattcaaacaaaataaaaacctatgattacc

SEQ ID NO: 257763 - DNA, 466 bp, Homo sapiens
gggcgggccgtctggcccgcgagttagttttgaaagccctgcggctgaaggttgcactattggcttccctacttttgaggttttgggactccgactggcttcctggctcctcaccttgcagatggtctattgtgggacctcatcttgtgatcatgtctcagtatgttgctcagactggtcttgaactcctggcctcaagtgatcctcccacctcagcctcttgagtagctgggactacagttgcaagccatcctgtctggctagttatctttaattaatgacatttgttaaagtaacacaaaaatcctagaaacatttgcctgttgaaactttctgataatttgaatgaagtaaagtttggagtctctgtctcattgaaaatactcaaggttaatataataaaaacagcaaagcagtaatgcataaaagaattattagaagtctaataaaattatttggacctcca

SEQ ID NO: 257764 - DNA, 609 bp, Homo sapiens
ttcaagcgattctcctgcctcagcctccctagtagctgggactacaggtgcgtgccgccatgcccagctgattttttgtatttttagtagtgacagggtttcattgtgttagccaggatggtctcgatctcctgacctcgtgatccacccgcctcagcctcccaaaattctgggattacaggcgtgagccaccgcgcccagctataaagagaattttaaaatgccacttctttcttaaaaccaaatcacataagtacaattctaacacttatactaagcgagtgatttccatcctcctttggaattctctgcttctagaattgtttcccatatgcttaggatgacaaagtattatggatagaacttcactataacaatggtatctggggataaagataataactacatttaggttttccacaataaaatgtatttttcatcatgatatatcttttactgcccctcaacccaacaatttgacctaaatggctgcatgggcaagaatttactattagttagtcatgtttatttacactttgtcttattctaaaaaagatgaaaagctaagaatcattcaggggttttacggtagtaagacttataaattta

SEQ ID NO: 257765 - DNA, 467 bp, Homo sapiens
accttgcacaactccataccaaccatgtctttatggattacatatgggaccagaattgactgcagtacaacctgagtcttggcaaagtaccctgcaattcctcctgcagcaggaaaggataagcaagctggtgaagagatgccatgggcagttcccacccacctccctaccttgtggaagatgaccacaaggccatttctcattcgtctctttagtttcagttgagcacaggacttttgaccttgctcccttagggttcaactgcagacttctttgtgagtatacctatttggctaaggggtagagctgactcctcagtagcagaacgacctaccacctgtgccatctgtcatctggcctctctgttcagtgtcattctatggaattagagatgcagggagctgacaccatacaggtgatgcttatgttttttgtgtatgtaataaaatgtctgactgtatttgact

SEQ ID NO: 257766 - DNA, 459 bp, Homo sapiens
cgcatctccactctcaagttacctttcccattattgactgagctcctgccacaatactttgttctcatttcctcaaaaaatgtcaagctctttcctgcttcagcccccatatggtgccccctcctcctgaaatggttccccatacttttcacatagatttcttccactcatttgtcaggtttcagcttaaatgtcagcaaatcaaagaagtcatttttaatctctctttaaataaagtggacttcctcctcacatttggtaactatttcaaccccttttttccttcatatcacttggcatgattggtaatccttatcctattgtgtttggtctgtcttcctcactagaacagtctccataatgcccatcagttgtactcatcactgaattccctacttaaaaaaaataaggcctggtaccttttgctaaatgtttattcaataaattaaatcatggatg

SEQ ID NO: 257767 - DNA, 693 bp, Homo sapiens
gtaaaatatgctgattaattacttttattttggtaacacaacaataaatacatgcctctttgacattttaaacagctttactaaggtatcattgatagaaaataaactggacatatttaaaatatgtgacttgacagttgtgacatagatttttactcatgaactcatcaccataatgaagataatgaacacactcatcatccccaaaattccctgttgtcctgttgtaatatagctcctatccaatggtgcccccttcttgaaactcctaatttactttctgtcataaatttgtttgcaatttttacgattttacaaaaatggaataatgtattctgttgtctggcttatttaactcagcataattatttgaaggctcatctgtattgcagcacgtgtcagtggtatattcctttttatttctggagtagtattccattgtgtggataccagagtctgtgtatccatctacctgtttgtaggcatagatcccttcatttttattacctttcatgacgtttggtctcacaatcccgatattagtaactcctttctgaaaaagtatttcaaaagctaaattctctattctctccagatcatagagaggaaaatgacctctcaagaaaactcagggacagaattaggatatttataacaatagtaatagtctgatgatacacatagcaccaattg

SEQ ID NO: 257768 - DNA, 409 bp, Homo sapiens
ggctaatgtgggaggctcacttgagctcaggaagtcaaggctgcagtgagcaaagacggtgccactgtacttcagcctgggtgacaaaatgagaccctgtctcaagaaaaaaataatcacttttattgagctaatttatatatacctatttaatcctcagtggccctaggaagttgggtctgcatcaaatcttcttagatttgaccataatcaagctgccaactcctccttttctatgcctactatgtgccaagcttagtgctaggtattttactgacattgtctcatgtcatcttcagaaccaccttaggaattaaaagccagtatccttattttgctcaggaggcagaagagttactcagcagctcaatcaggggcagagttgggatgtgaacccagtcctatccac

SEQ ID NO: 257769 - DNA, 423 bp, Homo sapiens
ttccccacttgggaggggtaactggcttccataagaggcctggcaggcaggccccttgggatgtcccggagtgtgtggcatttatgatcagtgccaccccagaagcaggccccttacgcctccctggatcatcactgcaaaaccctctgaccaacatcctttgccatgagcctggggcaggtcctccccgagagcatcagagccccaacatcatttgcggggttctctgtcattgacctaggacgcggtgaactggactctgtgtaaggcagtgtaccccaatgtttcctggggtggaggtgttcatccatccgaatgcttcttttttagcatctgccgtgtgcacagagacactcagagccctgtgcttggtcgggaagtacctgtgatgtgggatgcctatgggagctttggataagagat

SEQ ID NO: 257770 - DNA, 501 bp, Homo sapiens
gcgccaccacgcctggctaatttttgtatttttggtagagacgggattgcaccatattggccaggctggtctcgaacccccgacctcaggtgatccacccgcctcggcctccaaaagtgctgggattacaggcgtgagccaccgcgcccggtcagactctctcgtttctaggagggacggtcttggaggctccaaggagaaggcgtcgcctggccccaggaagcgccctggtgaggcgtccctccatttccccatctcctgcggggccctcccagggcgggctccacgcctgccccgcgcgcctgtgtaggagcctcgaggcgggcggggttccagcgcgcagccggccgccctcaaccgctcccagcatcggttgccggtggttcggggcagggagacgacgcagcgcgagcggaaagggcggttacccaacggccttagctctcatggcgtcctccgtggtgttacctaaaaataaagttatttgtgattagaaggtaa

SEQ ID NO: 257771 - DNA, 352 bp, Homo sapiens
tgtttcccacctccccccttccctgcaagcaaattaaacaacaacagtagcagcatcagcagcaaaaccccaaacccaatcctaaccaaaccacttactgaaagagatttgtagtggtgagaaaaagagacccaactgaggaatcatttgggaaccgcaggtatggtgccatttaaaaactggttctttctggtgttatttctagaacttgtgtttgcaaacagattagaattctgggctcttgtcagcctaatggagttctttatactgaagggtggcctggggtgtcctctgttaacatttatttctgtaagtattaaagtatattgaaacaaataccctttcacggctc

SEQ ID NO: 257772 - DNA, 675 bp, Homo sapiens
tgttttgtatttttccaatcatgaaaagcacctttgacataatccaaagccagacgtaagaggaaagaacctggatattttaaaaaccaaacagccaaactgattctatcatcccctaataagaagatgagaaaacaagcatagaggttaaaaaagtacccccaaacacgaaacaaagaattgatggccgggatcagatgcttggattctgtgctcaaggcctggatatcttctggtttttaaaaatggtgtgtgtttgtttgtttgtttgttttgagacagtcttactctgtcacccaggctggagtgcagtggtgtgatctcggctcactgcaacctctgcctcccaggttcaagtgattcttgtgcctcagcttcccaagtagctaggattacagatgtgcgccaccacacctagctaatttttgtatttttagtggagacagggttttaccatgttggccaggctgttcttgaacttctgacctcaaataatgcacctactttggcctccaaaagtgcagggattacaggtgttagccactgtgcccaacagtttttaacaatgtttttaaaaaacttattggtattaagaatacatgctcaccagaaagtttgagcatatagaaaagtagaaagaaggcaatcaccactcagaatcagccacttttgttg

SEQ ID NO: 257773 - DNA, 155 bp, Homo sapiens
aaatgctatgttgatgtattacacctcagaacaactatgaacgtgccatctgcagcaggaaggtttattagactacaaatcaggatacagatgttggagggaaagctacgtatgctaagtcataatacattaaagcacattttaaatctatatat

SEQ ID NO: 257774 - DNA, 453 bp, Homo sapiens
tactacgtgaaagtaatgtttaattaaattaaaatttaatcaatgtatctttaaactcaccaagtaaaataaattcctgtgttatcaagtttttacctcttggaattaagctttaaattttctatttcattttaccagtgggttcactggtgattggatcagcaactccaaatatcatgatgtcctttacaaaccttatatattgtccatagtaaagtagttgtcgtaatgaacaagttttggcagaagaaagatttctatggtagtcttttgaaaatcattctaaaatgaagattgtggtaaaagtcctcttatgatggaataaagagaacaacttttattaatttcctgtgcatgtggatattcaaaagtgtatggattttttaaatgatgattctgtaagaactcatagttgattacttagccacctgcaagatattcctttgaggaaaa

SEQ ID NO: 257775 - DNA, 274 bp, Homo sapiens
gggcgcggaggttacagcccatcgccgagccttacccgctcgcagtcccggttcccgagctcctgccgccgtcgccctgtggaggacacccctgccggccccgcagtccctcctcgacttgcgctggcttcggccgtcctggaactcgagctcgttcccccctccgagccttttgcccttgcggttcccgctgctgggaacgaccttgccctcagccgcctggctggtccctgcgccgctgcagtgcgaatgtcgccttctcaggggccctttc

SEQ ID NO: 257776 - DNA, 372 bp, Homo sapiens
taactgttcatgtccattttgagacatcagttcttgattcctaccgcataggcatgctgtcttcctcaataaggtgaagcccgtaggcttcttggaagttcgcagaagatttaggtctgtttaagtacctactttccaaagactgttatttggaaagacaccagaaattgtcaattctttattttttacccccctcaggcatagaaattgaatctgaaatggctgatgaataagcaaaggcttataatagagtacatttctatttttagtgtttcaactcttctttaaaatgagtaacattgtttctttaaaatagggagtccattatatgtatcctcttagaaatgaaataaattttttcggactctttgt

SEQ ID NO: 257777 - DNA, 538 bp, Homo sapiens
tctgtaattgtatatgtcatgagagattgcttttaaccttccaatgttcgtggtctcattttcactaacataatcccaactttagctgcgcacaataccacatttcccagcattccttgcatctggatatagctgtattcaaataagccgtgtgaaacttctgggatggctccttaagtgcagttgactcattagggaggtatgtcttttttatttttctacactttgtgctgctgtcctggagtacagacatggtggctagaagcatgaaatcaccttgaaggtagaagtcatgcattgaagttagtaaaagtgaaatgtaagtgtatagtttcctgatgaaaatgggaagcttatgtactagcaacagaatgcttattatgcaggcttcctatatgtaaaagaggacaaattctcattttattaagtttctgaaagtagatttctaaatgctggttctattttttattgaaagtaatggcaaaaaacgcaatgccttttgtaccaacctaatagttaataaacatatcctcaaatg

SEQ ID NO: 257778 - DNA, 478 bp, Homo sapiens
cttgatctcttagtccctgtgattcaggaaattgtattaatgaatttatggtcaatactactgactaggatgctttcaataacatagtttaaaatgtagtcacacttatagctagaatggtgaaacaaaagtttgttctccttaaagatttaccttgttaagaaatagtttctgatggctcggcacactggctcacacctgtagtttcagccttttgggagaccaagacaggaggattgcttgaggacaggaattcaagaccagcttgggcaacattgcaagaacccatctctacaaaaatttaaagaacaaaacttagccaggtatggtggtatgcgcctatagtcctagctactcaggagggagaggagggaggatcacttgagcccaggagttcaaggctggtgctaagattgtgccactgtactccagtgtgagcaatagagttagaccctgtttcttaaaaaaaaaaaaagtc

SEQ ID NO: 257779 - DNA, 261 bp, Homo sapiens
cgcctggctaatttttttttttttgtatttttagtagagacggggtttcactgtgttagccaggatggtctcgatctctgacctcgtgatctgcctacctcggcctcccaaaatgctgggattacaggcatgagccaccatgcctggctgagtttctagacttatagcatgggtggctggatcagtaacaatccataccgatcatttaagtgcttaagacagaattccatttctatatctaaatcgtcatctgtctctact

SEQ ID NO: 257780 - DNA, 465 bp, Homo sapiens
cttgggctaaaatggtccgtggaagatgtaagcagggctgctttcgacttcttaacgtcacaagtaacagaggttttttttcttctttttctgcctctcttggtgcaccacagctaccaagtaaacaaaaagtcccaacaagcagtaattatagcggcagctgccccagtgatgcgaacataaatgcaaagaccttcaagcagcaggaaaaaaagacaccatgtccgagatgtaattttccgagctctttacaaatttatgtcacagactaaggctttagcctttgcaaaagcatgcaacctgaaccagactgtcttgaatctccagtccagaaaatgtcctcttttctctctgtcacatctttgaagcgaatccacgcacatcttctccccaacttcttaaagcttgtgtttgttttctcgtaactcattttgattctttaaacttggatgtcatgaactagaa

SEQ ID NO: 257781 - DNA, 410 bp, Homo sapiens
gttaggtataaggtgtttcaaaaaaggaggagagtgggactgaatgttgggcaaagctgggaagacgtctcttgtagaacggtgacatttgagctggagtttttcaggcagagaagcacacggacaagggcatgtggaggagactgtgcagaggaactgtctcaaagcctgcagcctgtttgggaaacagataaatttgtggctgaaatggtgtgtagggtgaagtggttagccgggagtctggagaggagagagaaagaatttggtaatccaagctcaggactgagtgaagttggtagcaactctgtgttaagatagctggttgaggccgggtgcgaggctcacgcctgtaatcccagcactttgggagaccgaagtagacggatcacttgaggtaaggagtttgagac

SEQ ID NO: 257782 - DNA, 505 bp, Homo sapiens
gatcgtgccacagcactccagcctgggcgacagagcgagacactgtctcaaaaaaaaaaaaggagggagccaggtgccgcggctcatgcctgtaatcccagcacttggggaggctgagacaggcagatcacctgaggtcatgagttcgagaccagcctgaccaacatggacaggttaaaaatacaaaattagctgggcatggtggcacatgcctgtaatcccagctactcaggagtgtgaggcaggagaattgcttgaacccaggaggtggaggttgcggtgagctgaaatcgcgccattgcactccagcctgggcaacaagagcaaaactctgtctcaaaaaaaaaaaaaaaaaaaaaagttttaatgtttgaatgactttactcacagcttacattttctaatttggctgagtccccatcactttctgtttactgtacactgaatctctacctcactcatttatgctgtttacctagctcctggaggcaattgagttgtgatc

SEQ ID NO: 257783 - DNA, 374 bp, Homo sapiens
tagctgggcgtggtggcgggcgcctgtagtcccagctactcaggaggctgaggcaggagaatggcgtgaacctgggaggcggagcttgcagtgagccaagatcgtgccactgcactccagcctgggcgacagagcgagtctctgtctcaaaaaaaaacacaaatattcatataaggtggacaagggggccacagttatgaaacataactttagtgtttcagattcctctaatcaaagatgtcattaacaggccgggcgcggtggctcacgcctataatcctagcactttgggaggccaagacaggcggattgcctaagctctggagttccagaccagcctgggcaacatggtgaaaccccatctctactaaaat

SEQ ID NO: 257784 - DNA, 2140 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatccc

SEQ ID NO: 257785 - DNA, 3612 bp, Homo sapiens
  misc_feature (2098)..(2099): n is a, c, g, or t
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtagggagggccagatcccttccagtcttctccatggggaagagatgcttctgggccttttctccagacattgcttgtggggctggggtcacctccccaggcatccttttctcagcccagtgcctgccagccctcttcctcgcaggtggtaccgagcccccgagctcctgtatggtgcccgccagtatgaccagggcgtcgatctgtggtgagacccctgtgggtggtcaaagggtaacatggctcatggatttctgctaggctctgaggtctctgagctgtttggtggtcttttccctggtgggagtttaggcttccttaagggtgtcttccctggttggggtattctgagcactttggggttggggttcctcactatgatgttttcgagctgggtaggggccaggtgggatgagaatggtggtcccaggtgggaagctttctgggctagatggggaggtggtctgagccgatatgtgctggagttagatcctaggatatggcatctctgagctggtcagaggcctgtgtccttggacatgaaagctctgagcttgttttgcagcaagaagatagttggcagtgcccatgggtctgagatttggggcaggtttgcaggtctgccccagaagtgtcctagagcaggagtctccgagaagtcttggaacagctggggctttgctctgggttctagggttgagggctttgagggttcagggactgggcctctggacgtgaggctccagggctggcttgtggggccttgccctggagtgcagtgttagagctgctctgtgggtgggtctgtggtccatggtgggagatctctgacctgcttggggctctgtgtccacaggtctgtgggctgcatcatgggggagctgttgaatgggtccccccttttcccgggcaagaacgatattgaacagctttgctatgtgcttcgcatcttgggcaccccaaaccctcaagtctggccggccggtttgtaggggcccttggtgaggtgggtgtggggcaggtttactccactcccaacagcaagtaaccactccctcccctgaaccttctctctcctggccccaaccccccttgatggacagggaccactgtcctggcccaactcagggcttcctccttcctgctgtcatttgggttggggtagatcctgtcctttgtcccttttcaccccagtacacacatgtgcagtgtctcagcaagctgtgcacagagtcgtcatctgagagggcaaggggatggatgaaggaatacaggggtgggtgagnnaatgaatgatgggtcagggagacacatggatgggagagcaccccccatgtgagtgtgtgttaggggctgagagttgacagcagagagcatggcaagggtcgggaactactctcattgtaccctgttccttctccctggcccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggat

SEQ ID NO: 257786 - DNA, 2112 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatccc

SEQ ID NO: 257787 - DNA, 2398 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaacagactagagaaacttattcttagccatcctttatttttattttatttattttttgatggagtcttgctctgttgcccaggctggag

SEQ ID NO: 257788 - DNA, 2911 bp, Homo sapiens
  misc_feature (1305)..(1306): n is a, c, g, or t
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtggtaccgagcccccgagctcctgtatggtgcccgccagtatgaccagggcgtcgatctgtggtctgtgggctgcatcatgggggagctgttgaatgggtccccccttttcccgggcaagaacgatattgaacagctttgctatgtgcttcgcatcttgggcaccccaaaccctcaagtctggccggccggtttgtaggggcccttggtgaggtgggtgtggggcaggtttactccactcccaacagcaagtaaccactccctcccctgaaccttctctctcctggccccaaccccccttgatggacagggaccactgtcctggcccaactcagggcttcctccttcctgctgtcatttgggttggggtagatcctgtcctttgtcccttttcaccccagtacacacatgtgcagtgtctcagcaagctgtgcacagagtcgtcatctgagagggcaaggggatggatgaaggaatacaggggtgggtgagnnaatgaatgatgggtcagggagacacatggatgggagagcaccccccatgtgagtgtgtgttaggggctgagagttgacagcagagagcatggcaagggtcgggaactactctcattgtaccctgttccttctccctggcccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaacagactagagaaacttattcttagccatcctttatttttattttatttattttttgatggagtcttgctctgttgcccaggctggag

SEQ ID NO: 257789 - DNA, 2274 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaacagactagagaaacttattcttagccatcctttatttttattttatttattttttgatggagtcttgctctgttgcccaggctggag

SEQ ID NO: 257790 - DNA, 2437 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagccgagggtgggctggcagtgtctgccttctatcctgcagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaacagactagagaaacttattcttagccatcctttatttttattttatttattttttgatggagtcttgctctgttgcccaggctggag

SEQ ID NO: 257791 - DNA, 2344 bp, Homo sapiens
tgcctgctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtggcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaagacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaatggctaaggtggcattgtctcatggctctcgtttttggggtcatggggagggtagcaccaggcatagccacttttgccctgagggactcctgtgtgcttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttatggtatcagataccaatatttaaaagtttgtataataataaagagtatgattgtggttcaaggataaaaacagactagagaaacttattcttagccatcctttatttttattttatttattttttgatggagtcttgctctgttgcccaggctggag

SEQ ID NO: 257792 - DNA, 447 bp, Homo sapiens
ctgggaaagtgtctgtaggttccactctctctaacatgggaagtgatgccagagggaaaggaagaggcaaggcagatgccgctgaggttggtgctgtagtggacatagctcaggcaggatgtgaatggggctagggctctgggagtaaaacagctctgggaagatcagaaacatgtgttaacatgaacagttatacttctttcctttatttctgttttgattttctgtggaacttaaaaagcctttcagaaggtattggaaatgtatttatgcttgggccatagctttcttgcttttgttttttccctagccttattgagatataatttgtatacaaaaaccttcacataattaatgtatacaatttgatgagtttggacatatgtatacacttgtattgtattaccaccaccacagtcgagataataaacatatctatcacctcca

SEQ ID NO: 257793 - DNA, 3161 bp, Homo sapiens
  misc_feature (603)..(603): n is a, c, g, or t
  misc_feature (2245)..(2245): n is a, c, g, or t
atcaagaccagcctgggcaagtttgagagaccctgtctgtgttagttcattctcatggtgctatgaagaaatacccgagactgagtaatttgtaaagaaaagaggtttaattgatgcacagttccacatggctgagaaggcctgaggaaacttataatcatggtggaaggcacctcttcacagggtggcaggagagagaatgagtggcaagcaaagggggaagccctttataaaaccatcacatctcatgaggactcacttactatcatgagaacagcagggggaaactgcccctgtgattcagttatctccacctggtcccacccttgatacctgaggattattacaattcaaggtaagatttgggtggggatacagaaccaaaccatatcactgttatctacaaaagattttttaaaaagtagccaagtgtggtggtatgtgcctatggtcccagctactctggaagctgaggtgggaagaacttttgagctcaggaggtcgaggctgcagtgagccatgattacaccactgcactctagcctgggtgacagagcgagagaccctgtcccaaaaaaacaaaaaacaaaaaaaaaccccaanctaaaaaatttatatacaaaaacctcagcatatttgtcaaataactgtgtcagtgagttcttaagcattttgttttcatataatataaaatattttatttcctgctgtctttctatgtatacaaataaccaagttgctagtttctttgttgtatgagcttttatgtaatttatggcatttccatttgtatgtagctgtaatgaactttgtctctgctttgttccttaccatggaaatgggttttttccccctcagatggattcagacaatagttctgggtggtaagtctccatgtaaggagttagcccttctatttacaaaggctgtccttaatttcataggtaatgtttctggaagttcagccattgacagaatgttataagagaaggttcttatcccacagagctttattatacattctctaatttcattttgccttatcattaatatatttttagtgtgttatacatgttacttatattgacttttcctttaacatttaaatagtgttgatgcaggatttttcttggcccctttgctgggctcgcaggagcaggtgccccatttactcagcctgccaggccgcatctggcttgcactccagtgtggatcccacagctgccacaactgcacactcagcccccacattcagtgggtcccgagttcttgtcccatgtccaagaagaatgaggtctcactgacaattgaagggtgatgaggacagagaattttattgagtgatgaagcagctctcagtctagagaggggacaggaaggtggtctctcactcgaagttgggtcatctccctcagtgtggctggatctggggtttttatgggcacaggatcgggggggcccatgggccacaggtagtattggaaaaggcaacatttgattggttaaaaagcattattcagaaagaaccagttgggaaagagcaggcaaacagaaatagaagttctctctctgggtcatgggtttcaggctgtttttgacttgaaggtggggtttcaccctgtctgactaggatttttctgcttcctgcctctatcagtgttgattgacttaatatttagtgagcttccatttgagcctaaagatgttatattaaatctaatgatttttatttgcatctagattattgcttatcatgtgtcagtacttctttcctgagtccatacttctttcattttttttctttttttgagatgaggccccactctgtaacccaggctggagagcagtggtgcgatcacggttcactgcaacccctcgagcctgggcacctgctcgcctcagcctctggagtagctggtactataggcacacaccaccacgcctagctaatatttctattttttgtagagatggggtttcaccatgttgcccaggctggtctcgaactcttggactcaagcaatccacttgccttggcctcccaaagtgctgggatttacaggcatgagctactgcacctggcctctattcatttttatatacagtgttgtgagtactaattttcaaatatttgttaacctgaaacccttcaaaagggttgaaaagttatctaaaagtacagttatctactacagatataggtggagaagcttatggtggaagaatgctagcagctacagccttntgaacatctcttcattttatcatctatcgtgtgaaagagatcttctatcgtttgaaagggatctttaatctttcctgtgtttgggtatcttcgaagggctaggccatacatagaacagggtaggagaaaggaggtaagtaaggtgaaaggagaaacagatttgtttgacacaagtgttgtagggactgatactttgttaccctcagttgtgtaacatgttgcttgattctgttgaagaccctgtattccgggtgttcattgattttttttgggatacttccttgacgatctgtatgaagcaccctaagagaacatgttagaacatgtagtttctctaaaaattccactttgaatttttggaagactgctatgtattagtcaaaaaatattttagataaatttctttcccctgccttcttattctttgactaattagtcaaatgtatacaaagggtgtcttcctgtatttgaaccaaccaaaaacacacatctgaactgtcagctaaggggtaggcttggtgttatgatcaattagaggagtcttgcttctagaacaatacccactagaacaataaaaaatccaagtctttttttagaactgttgatatgatttaaaagataagattaatgggccgggcgcagtggctcacgcctgtaatcccagcactttgggaggccgaggtgggtggatcatgatgtcaggagttcgagaccagcctgatcaatatgatgaaaccacatctctagtaagaatacaaaaattagccaggtgtggtggtgcgtgcctgtaatcccagctactcaggaggctgaggcaggagaattgcttggagccaggagacggaggttgcagtgagctgagattacaccattgcactccaacctgggcaacagagcgagagcaagactccatctc

SEQ ID NO: 257794 - DNA, 435 bp, Homo sapiens
gtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagc

SEQ ID NO: 257795 - DNA, 521 bp, Homo sapiens
tcttgaaagatatgttcaagttgttcttcaaaatgttattgatttcgattcctccaaacaatgtataagagtaccaatgtctacatgctcttggtacaatatatgactcacaacatgtatttttatttgatatacaaagagcttttatcaatcaataataagagaaaacctgctttggtgacatagtgagaccccatccatacaaaaaaaaaaaaaaaaaaaaaagccaggtgtggtgatgcatgcctgtagtttcagctacttgacaggctgaggtgggaggatactcaagcccaggagtttgaggttggaaggacagatgtcccagtagaaagatagttcttcacaaggacctgtgcaggcagttcagaaggcaaataatacaaatgacctataaatatttggaacaaaaaaagttaactgaaaaaaagcaaaacaaacaaacaaaaaacacctgaatagtgatgaaagaaatgtgaaattgaaactgtgaaataccatttttttccatcgaattagtt

SEQ ID NO: 257796 - DNA, 283 bp, Homo sapiens
cattgtagtaaaacttgttactgggcttgaatgaaccaagtgagctattgtgtgaacatggcagagagatgccatgggagaaaaaaattttgagaaagttatgaatctctaagcaagactttctggtcttgctactaacttttcttttttttttttcttcttatactttaagttctagggtgcagtacaccaacatggcatatgtatacatatgtaactaacctgcacattgtgcacatgtaccctaaaacttaaagtataattaaaaaaaaaagaaatggga

SEQ ID NO: 257797 - DNA, 383 bp, Homo sapiens
accagggctgggaagattacaggaaagcaggcaggagaaagagaaagatggaggggaaaaaggaggacccaggttccccggggcagcagtcctgccttcggccacatggacagattttcatcgccatcgagacgcagggcagattgctcggctaatgagtacatgtcactgcgctgctgctgctgctgacttgagtagtgagtgatgtcatgctggctgcccagccctgctataatgcaactgtcagggccccgtggggaaaacttggggagaaatacgagaagtctaaaaagcagcaaaaggcccagtcaagtgaagggaaatggaattacagtcatgctgaaagcaggcacactggagaattaaaacactttgttttggaa

SEQ ID NO: 257798 - DNA, 410 bp, Homo sapiens
gatttctctggcttcaaacagaaacaggcataagggaggatgcaagaagactgaggaaagattatggtattaacccaggagagagtcattctcaccagggctagattgagtgcagtagagattggaaaaaagagatatttggtaaataaaattgaaaggacttcatgttagatttggaaaggaagataatacacaataatatagtataaatatatggtggtcccattctctgagctaggaaacactgatttgggagaaaataacatgaattaaatttttgatttgttgaatatgaagtaattttgataatttaagagaaatgtcaagtagacaattggtttcagatttcagagaggtggctatcatgaacataagaagagaagatagtctaagacagaaatttgaggaac

SEQ ID NO: 257799 - DNA, 472 bp, Homo sapiens
cttttcagaagataggatgaaaggatatatatgggtaggagggttttataatgagataaatccatagatcttagtatatagtataagaataaatcccagaactgaaagatgtgagattgtaattgatcttagaaggaaatcaatagataatttctggaacataaaatgatatggtagtataaagcatgttattaggaaataaggatattgatcctagaataaatggctaaagaagttgaaaatggtagcctttagaaattggggatctgtagtggataggagagggaactgctgacttttcttgtaagcctcgtgaaactatttgacttttaaaacatatacattgttatttttattaaatcagaatttatattgtccttcacctcaaaaaagtaagaagaaaaaaatacatttggcaaatactgactaaagaaaagctagtgttgatatggacaaaatataattccaggac

SEQ ID NO: 257800 - DNA, 394 bp, Homo sapiens
gcactatccaaagaatgtcttgaccttggacaaacatctcatcttggaatttttcttgggctctggacacctgggaaacagcttgtaaagaccaaattctgttgtagaagtggagaacttcaaaaggagaatatgagatatcttgggattattgcctctggtttctaataaactgaattatgttgataatgcctatcccaggctctgtggtctgtagaaggaagagtggatgaggagtaaagagatactgagcttcagtcctgggttccaggcactgtagcttggtgatcaacagcccaaactccagattcacattgggtggcctcttgctcatgtgaccttagaaaatttacttaactttctgagaagcctcagtttctgaatctgtaaaatg

SEQ ID NO: 257801 - DNA, 96 bp, Homo sapiens
gatttggggacagtctagagaaagaagaaatgaggaaaggctaaactgctgtgctagctgctcacaactaaggggaatcagttcctactctggacc

SEQ ID NO: 257802 - DNA, 413 bp, Homo sapiens
gctgtggtgtattagatccactattataaaaccatgctcctgatgtagtgaggatttcttgttgtttcggcacaaattcatacccacataaccactttgtcctccttgtttgagcgtaatgacactcgacctccacaacgagcacagaactttgtttggcaatatgaacagttatggccacatccatcagcaaactttgttttgtggcagataccacaggttggcgcatcacccttctgttcttgctgttgctgtgattcttctcccatcttctttacctgctctttatacatttcaaactgctgatgcagttttttgagcacggactgctccttctcctcttctttcttctgcctatccatgacggccaggatgattttcctctcctcctccgtgaggtggctgaggtcagc

SEQ ID NO: 257803 - DNA, 417 bp, Homo sapiens
aaatgatagctatgcatgtatatgaaatggcaattagtcactttcaacatctaaatcacatcctaacttttattatggttatttgtgtccatgttttaagccctcacttagattatgtgttcttaaggtattgttaaatattaatttggaattctgcacagtgcctagaacacagaataaattctcaggtctacagaacatttcaaagcaacatctggcaaatgatcttaaacctcaacagagtgaaaaaagaaacacataatagatatgtttgcctttaaattactattgcaacttcaaaaagacacagatggtaaaaatttctgaagtttctgaagtaaaaatttttttcttctactcatttttgttctaaacatatcttaaaagattaaacagacttcagaaagtagaacttat

SEQ ID NO: 257804 - DNA, 430 bp, Homo sapiens
ttttaaaaaaatctcttaagtaaaagaaaggttaagagaacaattataaaaataaggaaaactttaatcaaataaaaacttatttggaatttacccatgaaacaacaaagtaaagcaaaaatcaaattcagtaaaactgctttctattaagagacatactatactctttgattaaaatgaaaaccagacaggaggcaacaaactacagctttgagtaatgacagaaatagaaagatatggaaagagagatagagacacagctagggctatagagaaaagaaagagtaagagaaataaagcaaaaccgccagaaacatgaggaaagctactaaaaacatggggtctacaaattcaactccaagcatctcttatttactatttaatattcaaatggcctagtactaagaaatgtgaaaagtctctatctttt

SEQ ID NO: 257805 - DNA, 741 bp, Homo sapiens
caccaagaggttggtgttaaatcattcaggagaaatctcccgccaagatccattgacctctcaccaggccccaactccagcattggggattgcatttcaacatgaggtttgggaagagacaaatatctaagctatattatctgtcaaagaccagttatctatatttatatgagtctatttctgggctcccacttcttatccattgatatatttgtctattctttcaccgataccatcctgtcttgattactattgctttactctttgagcatttaaatattatatgcttgttatagtatttataaatgtttgtaatttcctattttgatttccttctttactctaagacttactgataaatatgtttttaaaactatacacatacaaattttagaggctttcacttgttaacttcttatatgttatttgcttctgcaattttttgagattttctgtgtagcttatttaatggtcagtttttgtggacacttcacaagaaaaatgacgcatcttaaaaaattattctattagaagcctactttttaaaattatgattgatagtcctttataaattcctttttttgttattgctttccaattctacttccttactggtaatgtgtattgggtatccatctttcttgaatatttctcagaggtaaatgttgataaataatccaattgcatactctcttgccctggatagtagttgatttagggatataaatatagcccagtgct

SEQ ID NO: 257806 - DNA, 499 bp, Homo sapiens
caacccctaacccattttgtccccttagtcctgtccccatcccctcattctcaaagcaagggagtcatggccccatctgggatgtggggttggggggcacagctgtggagagctgggtggggtgggtgtgggggtccctggcacccagcccagagcaatttggtaaattagaggaaatacagcctctcttcctgtgccccctgttgaatactagccgcctggggtggttgggctgggagccaggctcctgggtcctgcctgggactgagggaggagggcactgggagtctggactcctggttcccagagaaggactggagtccgcactaggggcttccagaaggggtgagggtccagacaaggaagggttctctcctggctgtcatgctcctgtctggttgccatggtagcgcaggcctcgtccaccccacagacagccagggcgggggaaaggtccaccacccctcccctgcctcgaggccacagcccgtcccctctg

SEQ ID NO: 257807 - DNA, 357 bp, Homo sapiens
taagcattggggtcttgctctgttgcccaggatgggatgcagtggcacagtcgtaactcactgcttccttgaactcctgggctcaaacagtcctcctgcctcagccttccaaatagctaggactgcaggcactaatgaggcacttttatgaattattcattgagaggtttcagtgtgctaagttaaatcataaaagctctttcaggccttaatttcccctctgtccttccttccccttctcctcccccagtggatcacataacaaacattaagggtctgtaccagccatctttcctaaattactcttcagcaaaattgtgggaacaggattccaccacctcctaagaatgagagttg

SEQ ID NO: 257808 - DNA, 694 bp, Homo sapiens
caggcagttagggacacagcagtgaactaaataggcaacaatccttgcctttgtggcactgacattgcagagggggcaggcagacaatgaatgagcagacaggtaatagcagtggtatattagatggtggtatgtgatggagaaaaacgtagcaagaaaggggctgagggagtacaggatggctgtcagagaaggcccgtggagaagatgacatttaaagcatatgatagagccagaactgcatcgatctggggcaggagcatttcgtgcccagggtacagaaggcacacaggccctgtggggaagctgtcaggtgtattctaggagcttcagggaggctgctggtgtggctggagcccggtgaaatgggcagagtgtgctgaggatgaggtcagagaggagcaaaccctttgagccttacaggccatgcctggaacttgggcttttactgtaagtgagatggagcctctggagatgaacagagcttggacaggatctggcttaagttaaaaagatcatgccatgtggacttaggttgtatgaaagtctcttaaggtactggtgagaacatagcacttaataaatgttagctgtcgctattattaagcttattaaaacatagtggggagaggggatcccagagtggtaagtggtttcctgtaatgcatgttacacttcagctccaccagcttct

SEQ ID NO: 257809 - DNA, 483 bp, Homo sapiens
catcccttgaggctctgggatgatgtcagtcacagtattctgcctgccctcttgctgcagccataaccacgtgacccggacctggccagtcgtggccagtcatagcacaccatttccctgcctacagaggggttcaaagtcttaggttcctaactcaaggagaggtgccaggacccaactccactgccagataaagaaagcctgtctgtgtttgaagagaatgaaaccaacacacaaagaaaagtataaaaagcagagccaagatatagaaatatttctactacagcattttagtacttggatttagcagtacctttggattcaccttcagccttttgagtcagaagagatgaacagatttgcttttttaaaagttattttgagatgatttatttcataatagagtcttacacaatgtctaatagtatatcaaaccaaatgctatgcaattgcatgaaataaaaggctaactcgcattaatct

SEQ ID NO: 257810 - DNA, 335 bp, Homo sapiens
atattttttctcactgctaaatttggctaaaaaaaaaaatgggtatggggaaagttcgtcatgttaacaattgtaggctgggtgtggtgtaacgcctgtaatctcaccactttgggaggccaaggcaggaggattgcttgagatcaggagtttgaaaccagcctggggaacatgccaaaaccccatctctactaaaaatacaaaaattagctgggcatggtggtgcacgcttgtagtctcaactactcaggaaattgaggcaggaagatcgcttgagccgagatcatgccactgtattccagcctgggtgacagagtgagaccctgtctcaaaaa

SEQ ID NO: 257811 - DNA, 403 bp, Homo sapiens
ctcagatacccttttcgagaaaaattaagatactttgaaaaagattcataatcagaaatattatctagtttaacttttttgaatggagagattttataggctggcaacgggagcttctgacttttcttctgcatgagcactgatgatggagggagtgactgtgtttgagtgaattttaggtagaagaaagggagcctggtaacaacaaactgtgagactggttgtattacgttacttgttaatccttctgaaggagagataccagggcctctgccctgcatccttccatgctagaaatattcatagttggaggaagcaagaaatgcagcccttgagcacgttggatttttttttaactattgattttgaaaaaaaaattgtttttgtaattatgagtaccagg

SEQ ID NO: 257812 - DNA, 682 bp, Homo sapiens
aatttataagattcatagaaatagacaatgcaaagagttccctgaggacaggaaccacatctgtattgttcacttctgtaacccagtgctttgcccatattagatgcccagaaaataacaattgagtttatgaatgacctctgatatctctacatccttaattcagtcttatttttatccactaaaatcatgagattagtgaaattgtttaagcacgtaaggatagttttactgttaatttagattttaccaataagcaagagtagtactattgctggatttatatgggtttgatataattttataatccaaaagaaagattggaaagggatgacaagttggttaattcattcttaactgaaagatagtggatagcatagcacataaaagcactggactctggagtaaaactgcctgtatttcagtctcggctatgtgatcttggtcaagttaccttacctctttgtgtattagctttcacatgtaaaatgggaatggcagtaataacacttccttataaggtataatattgtacattttgtgaggattaaatgagttaatacaaatataacactatattattatattgatgttgttagatgttattattgaaattgctaaattatttgatagttttacccaaagttgagattagtcttgatcacttataaataatttttat

SEQ ID NO: 257813 - DNA, 399 bp, Homo sapiens
gaaaactgaggataaattcactcttttgtatctatgaaacatttataaaaattgaccaaatttcagggtataaggtacacctgaatacatttcaaaaagtagaaacaggtggggcatggtggctaatgcttgtaatcccagcactttgggaggcggaggtgagtggatcacttgaggtcgggagttcaaggccagcctggccaacatggtgaaaccctgtctctactaaaaatacaaaaattagctgggcatggtggtgtgtgcctgtattctcagctactcaggaggccgaggcacgagaatcgcttgaagctgggaagtgtggaggttgcagtgcgtgagatcgtgccactgcactccagcctgaatgaaagagtaagactctgtctcaaaaaaaaa

SEQ ID NO: 257814 - DNA, 464 bp, Homo sapiens
ccacatactacatgattccatttatgtgaaatgttcagaagaggcaaacctacagagacagattagcggttgccaaggctgagaggtttgggtaaaatggggagtaactgctaataggtaagaaattcctcatggagtgatgaaaatcttctaaaactgactgtggtgacagtggtaatactctatgaacatagtaaaagccactgaactgtacactttaaatgggtgaagcgtatggtacatgaattatatttcaattcaactttttttaaaaaccctcctttgagttaattctgctgggcaattaggtttggttaccactacacagttgtgtctcagcacacttacagaggcaccctcgggatgcccagatcaaagacataaaaaaaaaatacaggcaattttcatctaactgtgacaccatgcaaaggcacttatgagagccctgcaagggtagaaggaaa

SEQ ID NO: 257815 - DNA, 362 bp, Homo sapiens
caatttagaaaatgaagctaaaagaggtcatctaagggaaatcgtttcctaacattttgatcccgcatgcctatcagcagagaatgttttgagcatgtactcctaatgtgtgtacatttatttaaacattctatgatggaaaattcttaatttgtatactatttactgttctactttttaaaactttttaaaatcaattttattgaggtatgatttacatacaataaaatgtacccatttaaagtgtatggaggccgggcgccatggctcatgctgtaatcctagcactttgggaggccaaggcaggcggctcacttgaggtcaggaatttcaccagagatggtggaaccccatctctacta

SEQ ID NO: 257816 - DNA, 485 bp, Homo sapiens
agcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgca

SEQ ID NO: 257817 - DNA, 255 bp, Homo sapiens
acttcatagaaggaatggaaattctacctgtttcctaaagaactacagaggtgtacaccaaacggagggcaaatgctgttaccactcatcgtgcaagacttttgaggcaatttggacatagacaagtgatgggaaaattgaatcattatatggctcatgacagtgttgaaaactcaaacatccaaggacctgtacctttgctaagtgccatgcatatgttgctgataaagatgcaataaatactcttttgttaaa

SEQ ID NO: 257818 - DNA, 118 bp, Homo sapiens
tcaccctatacatgccatgaagcctctcccagaatgtcctcctctttatgcctcgctcagttcatgagggtacagggttaaggacagtttttagtcctccttttgcagtaaccctgag

SEQ ID NO: 257819 - DNA, 655 bp, Homo sapiens
gtcagccattctggaaaaaaacaacacccaccagtgtttgttttctcaaaatcctaggatatatttctcacttctaagagaagtaaatggtgtctgtttatagtgacctagctttatgacagctgcacatccccatgcatttctcctttttgagaacagtcctaattaaaatatactattctgttgttcctgtaagtacatttgaatttgtgaaaatatgcaaaatagatcaccatattcagatggctcacaagttcttagtgctttcatctttcttgaaaatatgtttgttgtttattatgggatgtgtgttatggtgccaagcaggtggctgaatttcaaggggaacttgtgttgaatgctactgtatagaagacatacatgcagtaaggaagtttatacaaacctttgtaaagttgttcctttgggcttttatggtgctatacagcatgctaagtctccaaactgagctgatttgtattcctgacgtcatcctggaaccacgtggaggccaagcctagtaaaaggaaaatgagtactaggtggtcactagttccttctctgaactctgatggtacaaagtgcctgaaccatgtggcagcccgtgtttagtgtctataaccagaaatcatggtgattgatgcatgcaaacctt

SEQ ID NO: 257820 - DNA, 444 bp, Homo sapiens
tgtagaacagtgattggtacatagcaagtgcccaaatattaagtaaataaatgtttgaagacaaaattccaatcctgaataaccctctgtaatagctggcaggggtagtaagcgttataggcatttctttggggtgagtgatgacagataagggtgataattgaactagaccttaaaagataacagggatttttatagtagaagaaaaacattatcatcagtaaaattttagtactagctaattattaaatttttttttgtaaaatttattcatttatttaatttttttgtggagatgagggtctcactctgttgtccaggctggccttgaactactggcctcaagcagtcctcctgcctcagcctcccaaagtgttgagaatcactgcatttggccttaacatgttttagtcttttttaaaaaacatcaaaacctgtcttttt

SEQ ID NO: 257821 - DNA, 309 bp, Homo sapiens
gattggcagtaaagtcctagtgatggacaacgcggcagtggggaaagtgacagccgtggctagatcatcagatgtgtctgtagaatccggtgtgtccctgtgaacatccgccagcagtaaccattcacattatttcaaaaacctgcattattaggttgaaaatgggtaaatcggggaaaaagccagcacttatccagctattcctctgtgaactaacccatgcataacaaacagatttttttaatggaagaattccagctaggacccgagcagctgggatcttcacactgaccgtccatgctgtgaacg

SEQ ID NO: 257822 - DNA, 444 bp, Homo sapiens
aaagaccatccaaccctgccaaaggcaaaaggattaaggataaatgaaagcaagataatgtagaagaactacttagctgctgggtttttggagatgagtgatttttttttgtagggagaaattatgaaacacattgaaatggacaaaaaattactgaatgtcttcaatgaaaaaacagccatagtttggcacaccgtcccgggcattctgttgctagaggggctgtccgcttttctttgtggtgctctgcacaactcggtaagacccctcgtattgttatcttacccttccttgggaaaagccattttgcatcgatttgtaaattcattccccagtcctgattcaacaatatagatgggtgctttaaattctgcttagagctggttctaacagcttactggtccccgggttaatgagtaaataaattttttacacgtgttcatt

SEQ ID NO: 257823 - DNA, 691 bp, Homo sapiens
taagacctgccagaatgctagtcctgagagtgtcagacaaggaagaaatccctgggcctcttcccctcacctggcccttggatttcatggagcagccacttagcattgaattgcactaccctgagctaaacgtgtctgtgctttctaagataagagcttgatccctttcttctgtcttaagacagcacctcctgaaaagaatcgaagttgtcacaactctcaattattttttaaatactgcatagattgagttttggtttattactaacccttcccaaaattgcatcggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccgggcctctcatatcacgaccagacggcgggtctccatcttctttgactcctgtggccctcgctgctttacacaatctgttctataaggttcaggtgttttcaagttggaaagatcataaatactcaaaattgttttcaagttagcaaattcttttaacagtcttttatgcaaaaattgaattaataaaataatattttgtaaagaaaaaaaaaaga

SEQ ID NO: 257824 - DNA, 225 bp, Homo sapiens
gtctcagtccaggtgacaggacagttcccccaccaaggtacctcctgcagccaggttgtagggcctcctttcagggagtcagagatgagggggtagaggctctgactaccatggcctcaggcagccagcttgcttggaaagctcctgggctgaacggatgtgtgtgcccaccccgcttagtgggccgaagaggatcagcagccagacaggggccctgaaggaggg

SEQ ID NO: 257825 - DNA, 182 bp, Homo sapiens
tctaagaggattttgggatccatattaaatgtaacatgtcaaaagctgttgcccggtgcctggctgatggtatgtattcaaaacaccttctcttccttaaagaaacgcttatacactgttggtgtgagtgtaaattagttcaaccactatggaagactgtggcgattcctcaaagacctaaa

SEQ ID NO: 257826 - DNA, 813 bp, Homo sapiens
ctaactacctgcctccctaagtcccaattttctcaactattaaatggtaaccaccacgctccttgcagggtttgcctggtaagcagcaaatacacaagaaaagtcaagccaataaatagttgtgtggttaccactatcttccagttggagcaaggtccagaattaggttcaaacgtcatacagctaaggaagaaagcaagctaggcttcaagcccagttttgtctgactccaaaagtatgtccttcaccactcatctaccctatttactagacaacactaaaaactcgccatctcattttttaacctctgccttccacctccagtctggactggctcagagtccatgttctaaaatgtactttgatgtgaccaaacagaattcagttataagggggcagggaggaatgggtagagaattgtgtgccccttgaaattcacctgactgaaacatggattgaggagaagactttagatagtgtgaccctgagcaagtcccttcacttcttcaaacttctatttcctctactgtaaaatggggaaatgatctcagactgcctgtaacatgaaacagttgggaggtaacaaagatgaagtactgtacttaacaagctcaccattatagctgggacccagaatgcccagtgaccaatgaggccatctgccaccaagccaattatcatctgcccaatatatattcccatgtgtggcatacagaatattgctggaaggaaacacaagaaaatgggaacagaaaggtaatcaggtactggggtcagcagtgagaagtatacttctttagctatatacccttt

SEQ ID NO: 257827 - DNA, 670 bp, Homo sapiens
attcattaaactgtactttagaatacacaatacacttttgagactttcaattttgccttgtaaagcagcattaagatttttctcctgtaatttgttcagtaaattttattaggtcttcctccgaccctcactagggagaagatgaagaacactcagtgagtaaagatacagagcagggaaggtgtcattgacaatagaagacaagttgatcattcagatagcaaaggactgggagcatgggttgtgattcatggagcctaaagcatgacagacagtatattttaagggagatagtgaaatttatggttcttgcacatgggatagatagttgccacctatggagcaccattggtattaggtgagagtgcccattttaaagtccagaatgccaagtcctgtgtaactagtcaaacgagagggttccctgatcccccttgcaagacgtgtgacaggggtgtggcttctctggccactgctgttgctcccccttatgggaaggggagcatgcagacagtcaggggcaggaaccgggatgagggcttttggactctggccccagggtagcatctaggggtgggtgcctgcagctcccgaagccccagcgggtatgctgcatactcttttagctctgcaatctgcagatggcttaagtgttaaccagctcagtgcc

SEQ ID NO: 257828 - DNA, 528 bp, Homo sapiens
ttttttcagtgacagggtcttgctctgttgcccagactggagtgcactggcatgatcatagctcgctgcagcctcaaattcctgggctcaagtgattctcccacttcaccctcccaaagtgctgggattaccggcatgagccaccgtgcctggccagattttgttttttgattaccttttgacatatactaactagattttcatctacagcatacggttgagaagataagttcaaagtctggaccaaaatgacaaagaggaaacaaagaggaaagtcttgaccaatagaagagattgctcctaatctggctttgtctgatatttgtggaaccctaggacagcaatctcactgaggacgtctcttgaaatttaacaaacaacaacaaaaaaaggcagaaagcaaaaaagagagagagaaatactcaaaatctcttccttatcttactaggttgttaagaaaattaaaggtggcgatacagctaaaaacatcttgcaaactgtacttgtcaagtgcttgtccaagttaca

SEQ ID NO: 257829 - DNA, 484 bp, Homo sapiens
aggcccggtactgtggcagcgctatttcacgggctgtgtttctgtggttgctcaggacgatgaggctgtaaggtgggcctccccggctccaggctccagttttgtcttcatgtgaagagcctcagggcacatactgaccaacatgaccaaagtgagcatcaagccttacactcagaaagtatatttatttgaataaaatatcactgttagacactttgggaggctgaggcaggaggatcttttgagtctggaagttcgagaccagtctgggcaacgtagtgagacctcatctctattaaaaatatggatagataaatagatagataattactgttatatttttgtatattggagttctatgtaagattctatttacaaaagcattcactgataaaattgaaagtttgcaggcattaatttttatatcactatacagaaatatggattttggaaaaatggatagctcttaactgagtaaagtggg

SEQ ID NO: 257830 - DNA, 116 bp, Homo sapiens
ccctagggatatatcagattaaggtctatagaaaacaactccaattgaagggttttaaaattatgtcattggtagggggtaaccctttgatagaaagcacaggtgcctgattaaaa

SEQ ID NO: 257831 - DNA, 443 bp, Homo sapiens
agtcatggccatcatgagcatgtcacagtgcagcagagattttgtttatggccagttttgcggccagttgatggccagatttgggggcctcttcccaacagcccacagccagacctagactccattcagattggttttgatcagcatgtagaaaatgggggagttgagtgtggtatacaaaatgggggtgttggccaggcgtggtggctcatgcctgtaatcccagcactttgggagtctgaggcgggtcgatcacgaggtcaggagatagagaccatcctggctaacacagtgaaaccccatctccactaaaaaatacaaaaaattaggcaggcatggtggcgggtgcctgtagttgcagctactcgggaggctgaggcaggagaatggtgtgaacccacggggcggagcttgcagtgagccaagatcacaccactacactc

SEQ ID NO: 257832 - DNA, 368 bp, Homo sapiens
accaagagcttctgagggacagggcagttccctaattctttacactccctgaaggcacctgttcaaccagggcagatggggtccagaagattcccatcagtaactgagccttccctcgacaaagaggaggtggggtaaagctggttttgtggggaggcaggctctagaggatgaggatcagaacagagcaggagggtgggggtggagggaaaaagaaacagaaaaacgtgcaagtcataaagcagcagggagccctgcaagtcattagataattaatcaaagtgaaaaatcagaaagccagccttggctgccattatggggttgcagctgtttttggagtttgattgaataaaatctttatgaagttc

SEQ ID NO: 257833 - DNA, 705 bp, Homo sapiens
ggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactgcaagatttgttgaagaatgaacaaaatcaagaagaaatgacattggatttactttgggacctctcctgccacagcagcgtttcattcccatcaaccctaagtggaacatctttccatttcctctctaggacgtctcttcattctgttgaagataattcctctatggatgtcaa

SEQ ID NO: 257834 - DNA, 758 bp, Homo sapiens
ggtggtaatacctggtgcagagcttgagtctggccagcgggtcaggctcttgctagatcagcaccggaggtggaagactggtacattttacatactttgggaaaaaaaaacgttgctgaagttactagaaaagagacagttcttctgctgacaactcttcaggaaataattttctacctccttaggattcgaagaccagttcattcttagtgtcttctgaaataaaattagaatggattgggatgatgaatattctcataattcttttgacctacattgtttgttaaactcatttcctggagacttggagtttgagcagatcttcagtgacattgatgaaaagattgaacaaaatgctgcaagcataaaacattgcattaaagagatacagtccgaaattaacaaacaatgtccaggtgtgcagctgcaaacaacaactgactgctttgaatggctaactaactataattacagtacatctgaatcatctttcatttctcatggagacttgataaaatttttcaaaacactggtaaaatgaatttttattttatcatggagtgggatgagtaaacagggaatacaactcattcaatttctatacgtaaatatttatttgagtgaccatattagcctgccatacataggggtttgtgtttttatgttcctatatccccaacataatccactgagctatttgttttaatttttaactatgatttttatcaataaaataaaattttatataaatggagata

SEQ ID NO: 257835 - DNA, 369 bp, Homo sapiens
tttgtattcagagccgaactttttactgaagatcagctgcttagagggtgagatactgcagatgacaaggcatatgcagtataattgtctaggagtcaataaatatctttgagtaaactcatgaatgaatgtaaagattatacattctttatcataagagttatttcatggttttatgatacttcatatctaatgtatctttactgaggggaagcttaatgccccaaccacagagatgctcaagaaaagttccatcttttcttgaaaatagaaacccaacttcacacatattttactcaaggactacaaaattaagaagaaagcaggtaaagaaaatggcagtaattagcttgcaagtaggatttaaaa

SEQ ID NO: 257836 - DNA, 2086 bp, Homo sapiens
ctgagaaagacttttttaactttcaatagagcagttcaccgatagttgcctgggaagacactgagctccaggccgttagaggtattcaaactgaggcgggatctagaccttaagttccaaatattacataattaagaaataacttaatttttaaaaacaggctataaatccattttgtcaggtgtaaaacagtcaaattgaaagtcactgttttcaagcctacgttatcagatacacaaatgacaactacctgtagctggggagaacatcttcacatgccccataaactccattttggcaaaagaaaaggcccagggaggaaacacacttgcagtgaccaaacatgcaatgaagaaaaaaaaaaaaaaaattctgacaatctaaaatctttttgctaaacttcagtgtagctgaaattgtcattatctctcctattcatatttgaccaacagacttcttactgaccaccaactgtgcaaagcattagagacagattgatcaaaagacaaccttcactgaaaggagcgtctagccactgaagtccaccactctgtagcataagtgctgtaagagatcagttattatacaactgaactcctcaactgttttcttctaagagttttatagtttaagcacttacatttaggtctctgatccatctggagttcatttttgtatgtggtatgaggttggggcccaacttcattcttttgcatgtagatatccagttataccagcaccatatgtaaagtggctgttctttccccactgaatggtcttggcacccttgttggaaatcagttgaccatggatgtatgggtttatttctggactctcaactctattccatggatttacatgtctacccttattccagtaccacattgttttgattgctatactttgcagtaagttttgaaatcaggagttgtgagtcttccacctttgttctttttttttttttttcaagattgttttaactatttgggatcctctgaaaattcatatatgtgttttggtatgtttgtccatttctgcaaaaaagatcattggaattttaatagatgttacactaaatctgtaaaacgacttcaagagtattgccatcttaacaatattatgtcttctaatccatgagcacaggaagtcttttgcttagttagatcttctttaatttctttcagcaacgttttgtagttttcagcatacaagtcttgcactactgcggttaaatttattcataagtattctattttttgatgctattgtaaactgaattgttttcatagttacctttttgggttgttcactgctagtgtatagaaatgcaactgatttttgtgtggtgagcttgtatcttgcaactttgctaaaatttgtctattagctttaacaattatttcatggattttttaggattttttgtgattaacatgtcatgtgtaaacagagatagtcttacttcttcctttgccatctggatgccttttatttttcttgcccaattcttctggctagaatttccagtacaatgttgaacagaagtggcaacagtagacatcatttatcttgttcctgctactgggaggaaagttttctctttcaccactgagtatgatgttgctgtgggttttttatagattccttttataagactgaagttctcttattttcctacatgttgagcatttttctcatgaaagggtataagattttgtcactttttgtgcgtgtctactgagcttttttccccttcattctactaaaatggtacattacattgatcttcgtatgctgaaacacctttgcattcttggaataaatcctgcttggtcatggtatataattcttttaaaaaaatgctgctggattttgttggctagtatttttgctgaagaatttttatctatattccgaagagatcttggcctctacttttcttatgaaatatgtgtctgactttggtatcagggtaatgcttacctcatagaatatttattcttttaatttttgggagagtgtgaggattcacattaattcttctttagttgtttgatagaatcaccagtgaagccactggccctgg

SEQ ID NO: 257837 - DNA, 500 bp, Homo sapiens
tctcttcacaaataatttgactataaggattacattaaaatttattcattcaacaaatatttcttgaataccgctgtggtatatgagaagtcttctaagcagtgatgagtaagatagataaggcccttttctttgggagtgtaaatttctagaaaaacttctgtaggaaactattaccgagacaatgtactttaaaatccaaaaggtagggccgggcatggtagctcgagcctgtaatcccagcactttgggaggctgaggcaggcagatcacttgaggccaggagtttgagaccagcctggccaacatggtgaaaccctgtctctactaaaaaatacaaaaatcagccgggcatggtggcacacgcccgtaatccagccactcgggaggctgaggtggaagaatttcatttcttgaacccgggaggtagaggttgcagtgagcctagatcaaactaccacgctccagcctgggcaacagagtgagactctgtctcaaaa

SEQ ID NO: 257838 - DNA, 460 bp, Homo sapiens
gacaaatgtatgcgaccagggcagaggctgtagatgattcatatttccaattgggagggaggatcgcttgagcctgggaattcaagaatgcagtgagctataatgatgccattgcactgcagcctgggaaacagagcaagaccctgtctctaacagagaaaaaaaaaaaaggatgagaggtgaaataaacatgattaaatttatccaacatatgaatgctacaaaaactattgtataaacatgctttttaaagatgaaagccatgtgtccacatcccatttataaactctcattgaatcctaagtcccagcatttaagatcaattgtaagttctgtttattggccagacgaggtggctcacgcctgtaatcctagcactttgggaggccgaggtgggtggattgcttgaggtcaggagttctagaccagcctggtcaacatggtgaaaccccgtctctac

SEQ ID NO: 257839 - DNA, 336 bp, Homo sapiens
gtggaagtaactgataataaacctgatttaattaggcctaaaaagttttatttgttacctgttagtcaccatattttaacccttctttggccatatgtagaattagctgctgtccctctaccaaccttaagagatatgaaagtggggaaatggaaactcatcccaagaggacagttgaggttcatttgatgaaggagacagaaagctttgggttaaagattaagtgatccctttgcaaattaattcttatactaaggtactgtgaacatgggtcagttttcaagggtttctttaggtttaataccataatactaagatttcagtagcatgattatt

SEQ ID NO: 257840 - DNA, 483 bp, Homo sapiens
aggtgtgagccaccgtgcccggccaactttctattagtattacacttaattgggtgaacagtatgggagcctgactgtctgggttcgagtcttggcagtgacctaccctttctagtgggggtaagaatggtacccaccatcctgtggttgttggaggttgagtcaatgtatacaaagctgttttgtgagctgttattactgttaatcataattatttgacatgagacattattcgacagctgtaaacactctcctcatcactttcctgcctccttagttagaggggtggaggtgactacagctcctaggctgtagtcattttatttctgtctccaacttttcccctcaggagcgattttgattataatgtaggctagctccaattcagatcaagaaaaggaggtccaagtgtgcattgactttaaaatgtctaatgaaacttgattcctgatagataaatatattaaaatgtaatataactca

SEQ ID NO: 257841 - DNA, 316 bp, Homo sapiens
tatatatatatatataaaaccaatgttttactggcttaggagtcatcttttctcttaggttgatttttaattctaagtctcagaaaataatttatctattttgtgttggtcattgagggccagcactcctgacgtaaaagggtgagaaggtaggatggtggtgtatgatgacagattacttaatagttataatgtacattgagtgatggataccctaaaagccctgactttaccactatgcaatctatgcatggaactaaattacacttgtacccaacacatttgtataaataaattaaaaacatccactatttgg

SEQ ID NO: 257842 - DNA, 541 bp, Homo sapiens
taacttttctcatatcctatggtctgaggcttgtgagaggtaaacaacagtgcaatatggtgaaaactgaatgtgaaataggcctctttattttttaattttaatttaatttaattttaagtttcaggatacatgtgcggatgtgcaggtttgtttcataggtaaacgtgtgccatggtggtttgccgcatctatcaacttatcacctaggatttgagccccacatgtattagctgtttatcttgatgctctcctttcccctgccccccaacaggacccaggaacagaaaaccaagcaacacaggttttcacttgtaagtgggagctgaatgttgagaacatatggacacatggtgaggaacaacacacactgaacacctgttggtgggggtagagggagggagagcatcaggaagaacagctaatggatgctgggcttagtacttaggtgatgggatgatctgtgcagcaaaccactgtggcacacatttacctatgtaacaaacttgcacatgtacctctgaacttaaaataaaagttg

SEQ ID NO: 257843 - DNA, 449 bp, Homo sapiens
gctggctggaggactctcaggtcctgcttctatactcagaagaggcacttaatggagagaatgaagtcacgtgcacaacagtgataggaatggaaagactttgaaataaatatgtcttttaacaaaaagggagatctcactctgtgtccacccagtgctaagttctgtgcctaagagatgcagaatgtgtaagacatggcctcctgtcttcaagaagtgctttcttcttgagggcatttaatgaccaacagtgatccatggaacaccagaaagaataatttaaaaatggacacacagaagggcccagcattcacctttcagttgtttgtgtgttttaatagactttatgtttcagatcagtgctaggatcatagcaaaattgagcacaggtacagagatttcccatatacctcctctccccacacatgcgcagctttccctgctatcaa

SEQ ID NO: 257844 - DNA, 435 bp, Homo sapiens
ccagccagcgtgaggagtgcacagtaagtgcttaaaatagcaagtgaatccttaggctctggaaaatatggttacgtgattaatgtaaccagagttagagatgaaataacattaaatattttatatatatagaaacttgcctacacacacataaaattccctattagttgtagttgaggtttagtcatgttgaatcgataaaaaatgatttagagcggatggtttcaaaagctggttgtgctttcagtcttccataaagaagttaaaattaattttaatatgttgatggtgcttattgatgataatattcataataaatatccatcggaaaaattctccggcacatctgtgtgacagagaggtcaagaatgttaatgacgatcaggactacaaaatgcaatccagtcaattactttaattaaatctaaaactact

SEQ ID NO: 257845 - DNA, 833 bp, Homo sapiens
aaaatctgtaattattaaaaattttccatttaattgttacataccaaacaattgtattagtattgttaatactaaaaactgataatagttagctaaatgggcactcatctcctactatgtcaaggtttcaagacattaaaatgctctaaaaacctagtgaaattactgtttcaattatctgttgtaatgaaaaattattttaatttctaatatatgccttttttgagccaggcattgtgctaggaactggatgtagactatagcaagatacttatgtccacattatttaataggggaaaacacaggctgtaaaaatggcaggtgaggcatttatggggaactgttgcagtacagagagagaggtgcataactcaggctgaaatggggcagagggacagagaaatttcgttagagtagaaattaggtgaataaggagcagaatagaaaaggattccaaacagtgaaaactcagaaatacttggtagcctgtatgcattaaaggatgggttttgcttgggggaaagggagggaaccaagggtagaactctgaagagttgaactaggaaaggctaggaggttttctcaaggctttggggaaaatgctgaaaatgttttagtagagtgacataaaagtttgtattttagtatgtttaccttggaaaattgtggaattggtttagagggggtagataccagagtgtgaaatactggtgaagggactattaaagtaatccacagaatttgtttaaaggatatagagggagagtcagcttagattgactcgcaggttccagatgagtgactacatttgagaggagttaatcaggctaggg

SEQ ID NO: 257846 - DNA, 405 bp, Homo sapiens
aaaaaaaaaaaaaaaaaaaaagatggaaagagtagagagacagagacagagacaaagaaagatacagaagagagaaacagacacaaaagaaaaagagaagcagtaactcagaggatttaagtaaatgaatgagtgaaggagttagaccaactcagtgaatgaatgagtgtgtcatggggtcacagatgaacacatgacccaagctaagcccacgagaatcaatcctgggacttttactgaaattctcagaaagaggcacttttttttttttttttaaataaaccctagggtggtaggagatacctgcagctatgggggatccttttatgcccatgaggggagagcctggctgagagtgacactaacacagaatgagaaataaacatagttgcaacaccctcagca

SEQ ID NO: 257847 - DNA, 203 bp, Homo sapiens
agcaaaggaagaataacaatcagagatatctgcatcttaattagaaataattagtccctaacaaccagggacttgtgatttttgaaatgtattcttaatgttttgtgctctgcttaaaaagtcatgactaatgtccaaatcacaaggaagcattgagatttagactttaacagtggttcttaatgcttgctcactgcacccat

SEQ ID NO: 257848 - DNA, 384 bp, Homo sapiens
agaagtggccgaagcagaagtggggtcctcatgggcagctgggcccaaaagtgtccccagtcttggcccctcccagagatcaccaagatttggggcagtaaggaggaagaaaagggtgaaatgcttaaaagggcatcattaatccttcaaagcaatctatgaacatgatggtcattaagtcattaataaaaccctagcacttcctcagcggtaactttataaagcacttggaatattatacagctgtgaataactccaggggtgtgcaattttttgagggggggcaggggacagagtcttgctctgttgcccgaactagagtgcagtggcgagatctcggctcactgcaacctccgcctcctgagttcaagcaattctcctgcc

SEQ ID NO: 257849 - DNA, 108 bp, Homo sapiens
cccacatcatttcacaccagcacccactccctactgccactctgagtcctgctggcttctttccacccctggcacttgacaggatctgtcccctgacatagcctctgc

SEQ ID NO: 257850 - DNA, 398 bp, Homo sapiens
ccatttcagtttaagattccctctgacttatctaattgttaggctctcttcaccttcagcctgagaaatgggcaccatcaatttctcctttctcacccagcttcacacccaggccctccagactcagtgggtgtctgacacctctacagctggagtccttcagcaatgggccccctgggctcagcagatattttgagctggccatttcttctgtgagacaatcttgtgttttctcaggaattcccctgcagaagatctctgagtacaaacccatgcccagtgatgttgcctctgcccagctacttacaagaccattcctcggcccatccagggctaccaatctgtttatgtaatttgtgccatgaataaaggtaccagacaattgagtaagtggaggc

SEQ ID NO: 257851 - DNA, 661 bp, Homo sapiens
tattttacaagtcactaatattgcttatacaaagaaatattaaaccattaacctttatacctttcatctctccaatatgaatatggttattaaaccataaaaattgaataaatatacgtgtataactgccaacccagagatacacgggatacttatttggcgggaatgaaaattgtttattccacttaactttttagactcatggatactgtggtttagttcctatctgatagctggaaagcagtcaccacagatgtgtaattcattatatttttttgtatgttatttcataagtagtataattcactgtgacttctagtaaatgttagaaaataagactaggtgaagtgtagtgttaatgaaacttccttttgcatatagaagagtttaattattagagattattaatgaaaaataggttttgaaattcaattttccatctttaaagtctggttttgagtaaagtaggttagcttcataaaactaatatctagaattttaaaaatacaaataattgaaatcattgcatttgtgaaattttcattcaacagttttatattaaaatgtaactcctgaacatctggtgttttatcaggtattatggaagtgaagtaaacatcacagaccctggtttcaatctgtctaaaatcttatttaaaaa

SEQ ID NO: 257852 - DNA, 599 bp, Homo sapiens
gatgaaatagccctcacacatggcatgctgttaagcaaactaggtgtctttgtatcttgactgtgccatagtatacaatacaaatgttttgagtctatgtgtgctgaattcgaggttggtgagtacaaacttgcttccagtttgttgacttgcctagcatagcattaaataggaactatttctcattgaatgtacaataattaacttatgcagcacagtcatttaagtttaaagtgttttacccttccccttcccaaagttagaacacacacacacacgagaaagataatgtatggcaaagtcaagattaattttaggtttctgtgctcagacagtaccatggcattccagccagcatgactgcacaggcacagagtttttccagcaaatatcattaagtactttatttttgcatcacaaaaatttcaatacttaattttgcttaatcttgaaattaaagggttcatttaaagggaacattttttaaaacccttcaaattctaatctctactgcaatttaattgtttggagagtgacatgtcttatgagctaattaataatttattaaaattaagtggtgataagtttattaattttgg

SEQ ID NO: 257853 - DNA, 936 bp, Homo sapiens
  misc_feature (98)..(98): n is a, c, g, or t
  misc_feature (122)..(122): n is a, c, g, or t
  misc_feature (278)..(278): n is a, c, g, or t
  misc_feature (283)..(283): n is a, c, g, or t
  misc_feature (292)..(292): n is a, c, g, or t
  misc_feature (302)..(302): n is a, c, g, or t
  misc_feature (315)..(316): n is a, c, g, or t
caaatggtgctggagcaattggacattcatcggcaaaaaaacggaccaacacagactgtaattttcacaaaaattaacacaaaatggatcacaaatanacatgtaaaacacaaaactataanacttctaggaaataatatagaagaaaatctaggtgaccttggacttgattaatttttatgtctaacaccaaaagcatgatccatcaaaaataaatgtgtaagttggacttaaaattcctggctgggcatggtggcactttgggaggccgaggtggntggancacttgagntcaggagttnaagaccagcctgnncaacatggcaaaactggctgggcacggtggctcacacctgtaatcccagcactttgggaggctcaggcaggtggatcacttgaggtaaggagatcgagaccattctggctaacacggtgaaaccccgtctctactaaaaacacaaaaaattagccgggcgcggtggcggggcgctgtagtccagctactcgggaggctgaggcaggagagtggcgtgaaccaaggagcgacttgcatgaccgagatagcaccactgcactcggctggcgaagagcggatcgtctcaaacaacaacaaataaaataaaaatacactaatgcatatgatagtgtacagtacacatatcttatataatgaccaagccaagattgatgcttaccacctactggttgccaagcctttcatttgcattgcttcttctttccacactgacttgtgcacattttgagttaaatgctcacaggaatggtgtctgctttttttcttttttcaaatatctaaaacatacatttttcttgtgcagtggttatttaatataccataaataaatatatctgatacttaataagttatccataacttattagctcctttaaaaagcaaaactggctgggcacggt

SEQ ID NO: 257854 - DNA, 341 bp, Homo sapiens
gtggtaataaaagtactgacatagcgaccctggaaattagtttgcatatcttcagagcgtgccttcctctttgccagtagattatacagtttgaaaattgacagttccccaaatgtggcctttctctttctcttcctctccctcactctccacaccatcccgtctctttcttatccacaaacatgaacaatttgattatcagtttaaattaccagggtcaaactatcaatattatagtgaccatgagtaaaccatatatattttttccatatatgcagtaatgaactgagagttaacattttcaatgactgaaagcaggcctctagtgaccgccggcgttt

SEQ ID NO: 257855 - DNA, 693 bp, Homo sapiens
tcaattgatgcaccaaagattaaagtgctataaataaagaacaacttcagagaaactcatgctagtaaaatgaaaagccagtgacgatcccagatagtgtggctctgcaagcttgtgggtcttccttgtctacgtggccatctcttccctggactgtgagcacattgtgggctgctcttgggcttaaattgtccctatgcagtgtccctagaacacaaagccaggcacaggatggaggctatttgattattttaaaacactttctgaattgaagagagccaaataggacataataaaacgtagaaaacaagaacaaaagcaaagatctctaagtcttaagtggaaagaaacaatctcaaattctcagctggtctgtttacacttatttaacccagatgcttccatgaggagcaggaattgggcaggtatgtaatgctgcccaagggacagatggtctcagggaccacatttgccaaagcatgacttcattctcaccccacatcggggaagtgtgagtaggaaaggattcttcttcattaggttttgaagcacaaaataaagatctatctgacaggatgtgacttccctcttaaagcttgaaggaaggttcccaacaagtttgcttagttatttggaacatttaaagatggaatattatccttcgtatagacagagaggtgattggggaaggtg

SEQ ID NO: 257856 - DNA, 230 bp, Homo sapiens
ctaaataccgcagaggtgattgagtctcatagaaagctctcgtgactttgcactgtcatatccgtagccaagcattggttgcagcagatgagcaagtgtggtgttggcacaaacactgaaatgttcattcatgttaaggagcagatcaaagtgaaacaacaaagagttggggcaggctgcagccttagtgccatgagcggcttctttgttgaactgggtagtagtttttc

SEQ ID NO: 257857 - DNA, 334 bp, Homo sapiens
cttgggaatactgggagatggtctggatgacctgttggattcatcccatccattcgaaatctgtcctgtccccgtcccaacctcctaggcctctagaatccctaatttttctgtgccttgggggaaactgtatagggaatggaaagaatataggtagtggttaagagttaaggttctggggccaaataacctggatttatttgaaccttgacttgtggagttactgctggtgaactttcttacttctctctggaaataataacagaatctagctcatggtagtgtgaggcttaaatgaaatatatataaaatgcttagatgacatgataccaat

SEQ ID NO: 257858 - DNA, 373 bp, Homo sapiens
tgagctctgtggtctggcgggaaacctgaggtccgctgcgctccctgctcagcttggctaacgatgccagcgccggctagtacgcaaggtagcctggaatttctcagcccctgacctcgacagttgactttcagagactctcagcatttagcccggtgagcgggggcgatgaaagtgattccagaatggactggtgcagccagagtcacccttgggagccttttcctgccacctttggttaaaaccatgggcccctgcacccttaaattgacttcaatggagaattctgtttctgggccaggttcccgcttactgagatttaccagtcgttgcttggatgaagcattggcaataaattttgagaaaactatca

SEQ ID NO: 257859 - DNA, 302 bp, Homo sapiens
atttcttttctgtgtgtaaatagttgttttgttctttgggacagggtcttgctttgtcacccaggcttgactatagtgccataatcatgactcactgtagccttgacctcacaggctcaaactaccctcctacttcagcttcccgagtagctgggattatgagtgtgcaccaccacacgcagctaatttttttctttttttggatagagacagggtgttgcccaggctggtctctacctcctggcctcaagcaatcctcctgcattggcttcttaaattactggcatgagccaccatgcctt

SEQ ID NO: 257860 - DNA, 417 bp, Homo sapiens
ggaacagtgtgaatcacttgcctcacagcacagtgctgtgtgtataataagaacttgataaatgtttagtggagatgagttaatgtcatgaatgggtaagtatagaaatttaaaactgtaaagaatcttagtgatgggccgggtgcggtggctcatgcctataataccagcactttgggaggctgaggtgggcagatcacctgaggttgggagtttgagaccatcctggccaacatggagaaaccctgtctctactaaaaatacacaattagccgggcgtggtggcgcatgcctgtaatcccagctactcgggaggctgaggcaggagaattgcttgaatccaggaggcagagattgtggtgagctgaaatcaggccattgcactccagcctgggcaacaagagtgaaactccatct

SEQ ID NO: 257861 - DNA, 477 bp, Homo sapiens
agagtgacagatacttatttcagatgagctgtcatggaaaagatgctttatcttttacatatgaatttctcggacatatagaagatgaaagaaatgatcattttgcactcactgtggattgcttttcattttaacccatctgacacatactgggtggctggttgccctgaagtaaagcagttctgaagctttcagacttgtgtctgaactgatctgatcccaggaaattgctctatcttgattattctgttgtcagcctgatctggcaactggctcaatgagcctgactgtaaggtaggtaggtagctagcgagaggagtggttgagagaattgattgattgaaaatctcatctggaggttttacttaattagaagagatttagaagggtccatgttatcatacagtaattccagtccatggtgctgagacttttctaggttgagttttcagaatattaaaaattgtttaacaatca

SEQ ID NO: 257862 - DNA, 479 bp, Homo sapiens
gccgtgggcttactgtcagtgctaaggcccctgagccccagccccgaagagagacctctggcctgcagcagcccccaccttgctgaagaaccaatcctcggcatccttgcggttcttctctgccatcttctcatactgctcacgcatctcattcaggatgcggctcaggtccacacctggggcagcgcccatctccacattgatctcaccgcccacctggcctcgcggggcgttcatctcctatggaaaaaggggatgtggatgtgcgcatctggacccatcctgatctctcactcccaagccttcccccacgaggtgaccccactccccacaaggacccctcctttgttcttcctctgctctatctgaccctctaaatgatttttattcatctgctcagtattgcctccaccatcagactctatctcccccattagaccaacggctctccaaaataaaatctaattattaggcctatg

SEQ ID NO: 257863 - DNA, 460 bp, Homo sapiens
aaaggaaaataaaattaaaagagaaaagcaagttttcctgttttaggctgtctcatcccaaaaagcagtaacagacacagcccaggcccaggcaaggtcctgataacacaatctaagaagtcaagacccaaaaggaatgtgctctggagactctcccagcactccccaacataaggataagaaaaacaaattcctcttttagccctttaccccttctccataaatattttgcaagttttctaagttcctgtttctcctttgatgcagctgcaaagtcacaagctatgctagagattatgagacctgtcactgtttaattaactgtctttgttctgcttctgtaagcttgcttataaaaatcaagccctgtctttgttccaggctcagttttttggatgtgaaaaaacctggatccactgagctggtgtacaccttaataaaagtcctcctgtaacaccta

SEQ ID NO: 257864 - DNA, 697 bp, Homo sapiens
cacactagcagtgttaatttagcctgcagaactacatggctactggctgttgttcatgtcatcagggaacatacattttccctttcgccattctgggccaaagtggaggcatgtaagttttctggtaacattttctgtgggtcagatctttttctcattttccatgcattgaggacatcgtcctttggtatatgtactttatgaagggtttgccctttatctccctgtttttggtgatttttcttttgcagtagtagaaaaataatggtgtgtcttacaatcaaaggcgccttagataaaatatagtatatctttactttaaagaagagaaatttgacccaaggtgagtttaattaaactgacaaagacataacagacacagctattaagtactagaagaagaagaatgtaagtccaaatagtctatagccactgccattagtgaatttatgaaactaaatatttaatcttaaaaattacattataacttagaaatatccttatattatgctttttttaaattttttatttatttaattttttttattattatactttaagttttagggtacatgtgcacattgtgcaggttagttacatacgtatacatgtgccatgctggtgcgctgcacccactaactcgtcatctagcattaggtatatctcccagtgctatccctcccccctccccccacct

SEQ ID NO: 257865 - DNA, 225 bp, Homo sapiens
ttttgcattttgttacattttgttggctgatgggtacattgtcaacaaagctgtgccgggattgcagcagtttgagcagggagggtgtggggtgggacctactgcataaacagagattttattagtggatagttctctgaatatagccttgaaactgtaaccacccaacgggttcttcttgcctgacagccgatttatcaggacaggagaattgcaatgtcgacg

SEQ ID NO: 257866 - DNA, 188 bp, Homo sapiens
tctgctgtatcctcacatacagtgaagtttccatacaccttggttgaatgaatgtcttcatgagcagctacagtcttagggaaaacatgtagcttattaaggtggtgacagagcttccacttaaatccaggagatcccttgcccttaaatcctctgctgtctgctctgcgcagttgagggtttcatca

SEQ ID NO: 257867 - DNA, 293 bp, Homo sapiens
tgggcatcagtctccccctctgggaaatgggtatgaagacattggaagagtctcctgaaccgtggttaatttgtgccaagagaggctgggctgaaaggaggtatttgtcttcttatgtaatgtggtattatataatgctagattgcatatctatatgtgtaattatatctgtctttaagatacagactggcccaattcaagtgttagaactcttagtctaatcaggcctgtcttaaaggaggatcctgtcctggagagagtgtgccaagagtaatataatttttgccctagga

SEQ ID NO: 257868 - DNA, 484 bp, Homo sapiens
acatgagccactgcgtccggcctaaaaatcctatatttgcaatctatgtgaccacaactgatttaaacccagatgaagataaggtatcaaaataaacctcaggcagactgagctgtgccacaattttaacactaactgatgaaggcaggatgcttctcctgctcagctgagcatcctgtctcccaaactcaaaaaactaaaatcctggaatcttagaactggaagtgacccttgtctttgtgactgtccttgagctctgctacccatgagttttgcctccaaaattgtcccttttatatgaagtaggactctgcgcagccagaattttttgtgttacctctttgtaatcagatagggcacaactggctgagattgttgtcagtatgtgggtgtggctggaaaaaaataccctctgtgaccaatagttctttcttcactgtacacagctttcatactgtttctcatgaataaaacatattcacat

SEQ ID NO: 257869 - DNA, 166 bp, Homo sapiens
ggagtgaaataagactctgtgagaatccttggttgtagatatgtttagtgcacttgctgaagtggcattgttgtctggggtaaatacacaaggtttgttgcctcatgccaaggaaatcaaggacatgaacacatgtggagtgaggttaagagcataggtttaatag

SEQ ID NO: 257870 - DNA, 357 bp, Homo sapiens
tcgagatcttacccataaaacaacacaataatctgaagccacagaggctgcccaccaagaaaggaaggaaggagccctgagaccactggcagttaagaccaaggcctaatgtcacccaaatattggccttttcccattcaagaaacataaactgctaaaaaaaaattagactgaatttgcgttaacagaaaatatactctagagaagtgttttttttaaacaggatattggatagatatattttttaaaaaacaacaacccacctgagacctcccacttttagcataagctgaaaaagacaaagtactagttttattctccagttttggggtgagcaaacaagactgcagatctcga

SEQ ID NO: 257871 - DNA, 345 bp, Homo sapiens
tcacacgcagcccagtgcacatattttgctcattgttaggtaaaactgtatttactaatagctaaagaaaagtcaagaagaataagtaaatgatataaaatcattgacataatatgtatttattgagtacagcatccacctattaggcactaagctaggccatgggatagggaagaggacacagttcttgccccaaggaactcatagttacataagggagaaaaaacaacatgataaaatagaagttgtaaaaccttatacatacaggagcatctgagggcaacacctccagccttcccctcccaaaggcatttatgacattcacgggttccctagagctccttg

SEQ ID NO: 257872 - DNA, 1638 bp, Homo sapiens
  misc_feature (2)..(2): n is a, c, g, or t
gncacggaggctgttttccaatttgattcttattggaaagcataacaaccagccaggcctgtgctgctggagcgggcagttatgtgcagggagacagctggttacggctggctcttggcctcgacggagcttctcagcctcttggagcctctgtcccctcagctgctgaaggaacacatctcctgcacttctcaagttgctgccggtgcgaaggtgactccagattctgcagtttgggctccgtagctgctcagcaaatgtcagcaggtccagaagcaaggctcctcagctgcagagtgaatgcaaatgccccttctgctctcctgcagctgcggcaggtggaagagctgtcgggggtgggaagggggcttggagggataaggatgggctggggagggctcccaaggcagtggacactgtgggctctggggactgcatggctgtggagggggcatgtgctgttgggctcccagcctcttggggtcctctctgtgccaagatagagcctgttaccctccctgagcaggtgtgagcagacacctgtcccctgccctgcatgggaagtgaacgatccactaagtggggaggtcagggtcagatccccggccttcccatgcaggatgactgctcaggcccaggacaatgggtggtcaacagaaaccccatccctgcccatagagggtgcttcccagttcacagtgacacagcctggcctgctcctcttccagccacccaaggcaagacacagagcaggaggctgaggctggtgtgagggaaagggggatgcagcaaggggatacctcaaccttgcccgagctacagacaggtgaggacttctccctcacctggtgttttccactgcattctgaagagcaggtgacacccaccccagggtggatccaggatggatctctgggtttcctgccatctacaatgaccctcctcatttcccctggctagctgccccctaggatggagaatgcatcatggtcactgacacttggcgcccttttccagcctcaatggcctggcagagccagtggggacacagcaataatgtgggtggcagtaataacagcagctgaaccacctgagcaccatcctgacgaggcatagcctgagctctgtgaacagtgaagtccatctggtctctcagtggcctgagagtgactctaactattatcctcattctctgaaggaggaaaacaaggcaaggggatttaaataatttttaaaggtcagataccttcacaaaggctgaagtgggagtcagatgatagtgtctgggtggagaccccatactcttaccctcaactctgagccatctgctatacaacatctatttgctgagtggaaggtgtgtagcctgaaccatgctcacttctggtccagagctctttcctcagggccctgggacattcacgtttagtgtacagtggtatatgtatgctgaattcctacattaggccagccacatagtcagcactgattgctaaaagaataactgaataaggataaatgcttgaggggatggataccccattctccatgatgcgattatttcacattccctgcttgtatcaaaacatctcatgtaccccataaatatatacacctactatgtactcacaaaaatta

SEQ ID NO: 257873 - DNA, 370 bp, Homo sapiens
gaatttaatactttgagcaacagtgcatagtatcttggacaaacactgcaatacaggaatataatccacttacatagataatcaaccctatattttcatataacacttacccagttaatgcaaagtggaaaaaatatatatgtctgaggttacttaatatttttagcatgaaagagtctattaagctgaaccaagaaaattacaccaatctccatattactttgtctaaacacagcaaagttctgtggcagttgtgtttcatagtcctctattaataagtcactccactaaaaagatcattaggcaaacaagaatgccatctgctttaattctataagtcaattctattttatgactcaagtgtttacaa

SEQ ID NO: 257874 - DNA, 736 bp, Homo sapiens
tcccaagtcaagctgccagcagattaggtttctggggaggaatctattcctggcttgcagttagctgccttctagtgatgccctcgcatgaccttgccttgctgtgcacagagagagacagaaatcttgggtgtctcctcctgtttttataaggacatgagctctacaggattaggctattaagggcccacttttatcacttcatttaatcttaattaccttcctaaaggctgtatctccaatacagttacatcaagagttagaacttcaacatatgaattgaggggtgcaaatgagtccataatacaaagtaattaaattgaaaattgtgtctaatttcaagtgttgttcaaaatgtgaatgcttctttggttattgattctactttgtagagacttggtaaattttaactgagaacaacataaattgccttaatcatgtgattttaattggttgtcctatttatctttatatttaggcttcctctgaatttaccctattattatgtatctgggatgtatctgggattcatggttctaacccaaaacttactttctatacttgcttatttaaccttcacattgttcaggacattctagaaaacgtctaatgtttcctttggtacagaaattgcacatacagctgagatgtgcacgattctgttctctcatgttagttgggaagaattttatgagaattgggggtttctgtacttttgattataatgcgtgagcat

SEQ ID NO: 257875 - DNA, 368 bp, Homo sapiens
cttcatccctcaaagcatgattacacttgacctcagcatatgctggcgttcattactgcattcattaatgaatgcaaggaataactcctgaacacttaatgtgtatcaggtgctgtgttcttaagttgtcttctacgatgctctccgtaaatgagcatgttgcccatgctacttccagagccatttctgcggccccgtcttctctcctgggatgcactgatcgcatggtgggctgcatagccccttcaccatccgacgcccctgtccttccagtgtccctgctggccctcttgctcctgctaaggggctggagtaaggtgggtgagttgacactatcattcataaaaatgccactatattagagatta

SEQ ID NO: 257876 - DNA, 1368 bp, Homo sapiens
gactagtaataagcatcctgagtaatgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataaatgggggtcagggagggaaaggaggagggagagagatggagaggaggggagagagaaagagaggtggggagaggggagagagatatgaggagagagagacagaggaggcagaaagggagagaaacagaggagacagagagggagagagagacagagggagagagagacagaggggaagagaggcagagagggaaagaggcagagaaggaaagagacaggcagagaaggagagaggcagagagggagagaggcagagagggagagaggcagagagacagagagggagagagggacagagagagatagagcaggaggtcggggcactctgagtcccagttcccagtgcagctgtaggtcgtcatcacctaaccacacgtgcaataaagtcctcgtgcctgctgctcacagcccccgagagcccctcctcctggagaataaaacctttggcagctgcccttcctc

SEQ ID NO: 257877 - DNA, 310 bp, Homo sapiens
tggtttcccagaccacactttgagaatcaaggctgatgagacctctgtccccatcaggggaggaggatcccccctctccagcactgacctctattgtgtcctggctatgggtctgtcagcagcacacagagaaccctggcatatccaaatgtggtaattattttctttgcaacacagtgagctgccaggtctccccatgctcttcagtgtgctgggaaggtaggaagacacccagcaggaaggtgacagaggtggctctgggggatggaaaggggctcactgggggatgactggggagggaccagccctc

SEQ ID NO: 257878 - DNA, 1377 bp, Homo sapiens
tacactaaaactactgaattgtatactttgaaatggtaaattgtatgctatgtcaattaaaaaaaagtataggccaagtgcagtggctgaagcctgtaatcccaggctttgggaggccgaggcgagtggatcacttgaggccaggagttcgagaacagcctggccaacatggtgaaaacccatctctattaaaaaaacaaaaactggctgggcgtgttggtacatgcctgtcatcccagctactggggaggctgaggcacaagaattatttgaatccaggaggtggaggttgcagtgagccaagatcacaccactgccctccagcatggtcaacagaacgagactgtcttgaaaaaaaaaaagataaattatggtatttgctttggaattaaataattagtaacttttagtaaggtttggtaaaggtttagtaacctttagttaacccagttaacttctgtgtcttatatttgtctttgtactgaagtagttgaatgccactgacccacagaatgagttgccagagaactggagcaacattctgtttgtgggaaagagaatactctgttactaccttaatattagattcccagcatatcaattgaagggttttaaatagtgagtgatgtgtttcaatttatatttatattatatttacacttgatcttagccaaaaggctgagaaagcgattttatattatatttataaagatcactttagctttctcctggagactggattggtagggacaaggtgacattggtgaacttggttagaaagtcagtcaagcccgtgtgcagtggctcacgcctataatcccagcactttgggaggccaaggcaggtagatcatctgaggttaggagttcgagaccagcctggccaacatggtgaaaccccttatctactaaaactagacaaaccacttagctgggtgtagttggacggttgcctgtagtcccagttgctcggacggctgagcacggagaacggtttgaacccaagagggctcatctgcaggaattggacaattgcccattggaacaagcttgggcacaacagaaaaccgctaaaacaaaaaagggccacagacttgcaacaagaactccccgaacaacgggcccagggccacaaaacactgaaaacccgcaaagagggtcaaaatctatcaacaggggatcatcaaacaactccaaggagccccgacagcactagaaacaacacccctcggacaaatctgaaaatctcagccaatagaaccgatcaccacgaaacaactctgacgaccatgacaaagggagtgactcaccagcagactctcatctgctgcttcctgtttttttttttctcttgtttcagtcttggtctgtacataag

SEQ ID NO: 257879 - DNA, 205 bp, Homo sapiens
caccatcttattttcttcccccagttggccaaatccatcatgaagccaaagggcaaggaaacacctggaggcttcatagaggtcatcctcctggggcccagggcagggtcaagaagggtggatggtggaatagtgaccttggcatggcaagtggaaaataaccaatgagatgatgatcagaggagactgagacaagatggaacct

SEQ ID NO: 257880 - DNA, 645 bp, Homo sapiens
gtggggtaggggaagaggtgagggatagcattaggagatatacctcatgtaaatgatgagttaatgggtgcagcacaccaacatggcacatgtatacatatgtaacaaacctgcacgttgtgcatgtgtaccctaaaacttaaagtataatagtaaaaaaaaccgtatgatacatgtatacaatggagtactattcagccataaaaatgaatgagattctgtcatttgcatcaatatggatggaactgggggtcattatgttaagtgaaataagccaggcacagaaagacaaacttcacatgttctcttatttgagaaagctaaaaattaaaacaaactcaaaaacacttaatctttactggtgcctaggaggtagatgcattagcattcttattttatatatgagaaagctcagatttggaaagattcattaacttattatttaagttataataacttaataacttattatttaagttaaatggcagagccagtcctaaaatgctcctccacctgacttaagagttttgggtcacacctaaccagaaattctaacaaagggaagcaaatgtaaaaacatatgaacataaaacacatgaacatatgaacatgagattcaatgtcacaggcaacagaataagaaag

SEQ ID NO: 257881 - DNA, 357 bp, Homo sapiens
cctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttt

SEQ ID NO: 257882 - DNA, 318 bp, Homo sapiens
ctcagagtaaggttgaaggtttctgagcaggatggtgatgatttataggtagcactttgaggaatagtaaaggaagtgggatataggaaccagactgaaagcttatagtagagtatacttgatgtgttaagagtcctatgtggagtgggaagtacatacatggaaagttaatttataattgtaattaatgtatctaaagtacatgggaactgaaatgcaagatgattttttgtattatatcctggaacagaagaaagaacattagtggaaaaactgggaaatccaaataaagcctgcagtttgattaatgctgcttta

SEQ ID NO: 257883 - DNA, 1964 bp, Homo sapiens
gtaacaggcaggaagaaagctttctgtactacaccagagggttggggctgtggatttagctactctcacctgaggctactgagcaagctgtcatgcaccatgagacaaagcccaagctgtcccaccaggcagtaagtgtggagaggttcaggcacatggcatagctgctatttcgcacaattttcactacaccagtggtgaccaaatagaagaggttcatccatacacagaacctggtgaagagctggaggcagaaagaagtgtctatgtggagacgcaactgaaacaaaggtggcacagcaactgttccaatcccgtgtctttcctcatggcttcccaggagtttgaggttgaagctattgttgacaaaagacaggataaaaatgggaatacacagtatttggttcggtggaaaggttatgacaaacaggatgacacttgggaaccagagcagcacctcatgaactgtgaaaaatgtgtacatgattttaatagacgacagactgaaaaacagaaaaaactgacatggactacaaccagtagaattttttcaaacaatgccagaagaagaacttccagatctacaaaagcaaactattctaagaactctcctaaaactccagtgactgataaacaccacaggtccaaaaactgcaagttatttgctgccagcaagaacgttaggagaaaggcagcttcaactctctccgacacaaagaatatggagataataaattcaactattgagacccttgcacctgacagcccctttgaccacaagaaaactgtgagtggctttcagaaacttgagaaactggaccctattgcagcagatcagcaggacacggtggtcttcaaggtgacagaagggaaactcctccgggaccctttgtcacatcctggtgcagaacagactggaatacagaacaagactcagatgcacccactaatgtcgcagatgtctggctcagttactgcttctatggccacaggttcagctacccgaaagggtatagtggtattaatagacccattagcagccaatgggacaacagacatgcatacctcagttccaagagtgaaaggtgggcaaagaaatattactgatgacagcagaggccagccttttatcaagaagatgcacttcaccataaggctaacagaaagtgccatcacatacagagacattgtagtgaagaaagaggatggattcacccagatagtgctatcaactagatcgacagaaaaaaatgcactgaatacagaagtaattaaagaaatggttaatgctctgaatagcgctgctgcagatgacagcaagctcgtgctgttcagtgcagctggaagtgtcttttgctgcggtcttgattttgggtactttgtgaggcacttaaggaatgacagaaacacagcaagccttgaaatggtggacaccatcaagaactttgtgaatacttttattcaatttaaaaagcctattgttgtatcagtcaatggccctgccattggactaggtgcatccatcctgcctctttgtgatctcgtgtgggctaatgaaaaggcttggttccaaaccccttatacgacctttggacagagtccagatggctgttcttctattacattccccaaaatgatgggtaaagcatctgccaatgaaatgttaattgctgggcgaaagctgacagcacgggaggcatgcgccaaaggcctggtctctcaggtatttttgactggaactttcacccaagaggttatgattcaaattaaggagcttgcctcatacaatgcaattgtactggaagaatgtaaggccctcgttcgctgtaatattaagttggagttggaacaggccaatgagagagagtgtgaggtgctgaggaagatctggagctcagcccaagggatagaatccatgttaaagtatgttgaaaataaaattgatgagttttaaaaaaaaaaaa

SEQ ID NO: 257884 - DNA, 429 bp, Homo sapiens
aatgataatccattatgagatgcagttgaatttgctaaatctatttcaaaagctctgcttactcaaccatttatagcacatttgacaagtaattttttctatagaagactttaaataaaaaccattgaaatagtgtaagatcctagacccacatactgtctgccatcacacatcactttcctcagtgtctgtcagttgatgtttttgtgtggtgaatgtgaaccagtggcctgaagaaatggagagtaaatggtgatgaggtattgctgtaagttgtgttttctgttataactaagtcttgacttacccatggtaattctttcttacaaaccttccatatatgtgtgctggtttctattcctgatgctgaactgttagttttctaatatttaacttttggcttccaaaactacatgaagttatttttct

SEQ ID NO: 257885 - DNA, 279 bp, Homo sapiens
gaggcagaggttgcagtgagccaagatcacgctactgtactccagcctgggcgacagaacaagactcggtctcaaaaaaaagaaaaagaaaagaaaagaaaaccaagatggagagaggcatagtagtttctaagacactgagctaagaaggaaagaagctttcagtggaagccaagtctgtcttactctgaaatgtgtgttctttccactctttcaggctgccctaatttgctttttaaagaattttgtgacccaaataaatataattggtggcatttc

SEQ ID NO: 257886 - DNA, 370 bp, Homo sapiens
tccacaatcttaagaattaccctctattgccccttgggccccctgtccccagaagcctggtcagccaagactcacatccccaggtggctggcaaccaccagaagtggctttctcagggacactgccatttgttttcctgttcctgttcgctcctgctggaactctagggctgtttttctgccaatattcttttaactgttggaaagaagagcagtaatactcatgagaaccgtcagcccctgcagccacatcctcctttacagtttttacaaaatacacttacacaccatctgatttaatgacaccaacaaccgtacaaggtgttgtcacactcatttagtgactgagaaggattgatatcatggctaga

SEQ ID NO: 257887 - DNA, 580 bp, Homo sapiens
gcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaatt

SEQ ID NO: 257888 - DNA, 493 bp, Homo sapiens
aacggtgttaattgatctaaaagggcttgattgaaagcatcctaacatttccctttaccttgttttgtttgtttgcctgcttgcatgattatttttttctttctttctttctttctttctttctttctttctttctttctttctttctttctttctttctttctttcttttctttcttttctttctttcttttctttctttctttctttttttctttctttctttctttctttctttctttctttctttctttcttttctttctttccttccttcctttctttctttctcttccttccttccttctctctttttctttcttttaaaaaaccttagcagttcaagttagaggtgtttttttcttctctttttttttttttttttttttttgcctccaatgccaccacatcattcagtctaactattgagcattgcaggtttactcaggggacaattcttgccctccccaccccctgaccccttctttcaaatat

SEQ ID NO: 257889 - DNA, 368 bp, Homo sapiens
aacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaaca

SEQ ID NO: 257890 - DNA, 272 bp, Homo sapiens
agaaacatacaaccccccacatttgaactagaaacaatttaaatcttgaagagtaatagcaactagtgagattacatcacagagataaaatatatctcccaaaacaacaacaaaaatatcccaggaccagatggattctaccaaatctgcaaagaagaactggtaccattcctcccacaacttttctaaaaaaatccaggtgaagggaatcctccctaattatttctacaaagccagtcaccccaataccaaagccaggcattgacataaca

SEQ ID NO: 257891 - DNA, 663 bp, Homo sapiens
aaagtcttaatgagaatcattggtactcaatagaatagtgaattaaatacagccaggggaagacccaagtctcatatttctcttgtatattccaaagttccagtgaaattccaggtaatagaggttatttcccacactgttaaagcaaggttgcagacacttctgaatttcggtcccaatgctgaaggagggcacacctctgtcctggaaaatgacacaggaatgaatgctattcccatgactcattctggtcattcttccagcatcacagaaaccaaaaaatagaaatatagccaaatacatgatttgctatccctcttcttcaggtttcttacctgtttcttatggataataacattgccttaaggattatgatgaaaatatgatatccaagtatgtgtacagttttgaacaaaatgcctagtatgaattggtcaataaataattatttttatttattgaattacatggattctataaataattactgaataattattgtgattccttttattggcagtgctcaaaatgcatccctgtgtgacctcaagtaaaccagtaactttgtgaacctgcagttttatcatttttaaagtgaagaaactagacagattttcattctgacacagaatgtcaggtctttgagacaccagagaatagata

SEQ ID NO: 257892 - DNA, 636 bp, Homo sapiens
cccatatttcagagtatggtttaaatcaaaattggaatagcagatgactcttctgagagcaatttggatatcattcagttctgaagtagaaagagtttgtgggatggaactagcagggatagaggaccactgcatgtggagcctgatgaagtccataaccattgggaagtggcgcgggcgggtgaggttatgaagcagtatcctaggggatggtgtttttcaagttagagataatgacccataggccaggcacagtagctcatgcctgtaatcccagcactttgggaggccgaggtaggaggattgcttgagtccaggagtccaagaccaacctgaacaacatagtaagaccccatctctacaaaaattttaaaaaattagccaggagtggtggtgcacacctgtagtcccagctacttgggggtctgaggtgagaggactgctagagcccaggaagtcaaagctgcagtgagccatgatcacaccactgcactccagtctgggtgagagatcaagaccctgtctcaaaaaagggtggatgacctgaagtcaggaagttgaacccagctggcccaacatgggaaaccctggttttccatccatttttgccggcctggggggcaacccctgtccccg

SEQ ID NO: 257893 - DNA, 433 bp, Homo sapiens
taaaccgcagaggagcacatgctttgcctttctgcatagcaatcttactactgtattttttactatcctgatggatttttttctttaccccaatcttcttgaccatgtgtttttaacttttggattagatgtatctttaagctgcttcaaatcttttgtggaaggagattgggaatagaatagatgaaaaatagagaagtaatttattaagttcaacaaatgccattgttatagataaaatatttatcaaatcttctccacattagcactattaaaaatacttgtgctcagcactatggttgatccttgtaatcccaaaaactcaggaagctgaggtgggagaatcactttaggccaggagctcaaggctgcagtgagccatgattatgccactgccctccagcctggatgagagagtgagaccctgactcta

SEQ ID NO: 257894 - DNA, 531 bp, Homo sapiens
attactgaaaaattgtctactcgcagtttgagctgtgctggttaagggacgatgggttagcctgtctctaggctctgcagcacctgatccagctggaagggcagcccaccacatatagagcccatcattcatcagagatactcactgttccgctacagcccagatgatggtgtgaaaattgctttacattccttctctggagctaaaaagcacagagaagtcctttttccccaagactagtcccattgtcctagcctactttcctctctccccaaggcctttgcagcactttcattgcctactctgtctctgcccacagtcaagtcagggatcccattgctctgcattttcagcttcttcagagcaatgcaatgatgatatgcaaccatgagacacagaagacacagatactgccattttggtgatttaatcctggaagtgggaaactatagcctgaagctaaatcaggcttaacctctgtttgtgtatggtctgcaggctaagaatgatgtttacattttagatgtttca

SEQ ID NO: 257895 - DNA, 755 bp, Homo sapiens
atcaagaaattcaaacatgtccaaaatcatgagatcaaacaactggaaaaactggagaaactgaggcagaagtcaccctcggatcagcaaatgatcgccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctcagcttgatcc

SEQ ID NO: 257896 - DNA, 819 bp, Homo sapiens
atcaagaaattcaaacatgtccaaaatcatgagatcaaacaactggaaaaactggagaaactgaggcagaagtcaccctcggatcagcaaatgatcgccaggcagagaccagagtgcagagggccgctgtggactccagccgcaccaccctccagctggaggagactgtggatggcttccagaggcagaagctcaaggacctgcagaaatttttttgtgactttgtaactattgagatggttttccatgccaaagcggtggaggtgtattctagcgccttccagaccctggagaagtatgacctggagagggatctactggattttagagccaagatgcaaggagtttatgggcattatgacactcggctgcttgccaacaccagcccccctccatctgttcttcagtctctcgccagccagggaactctgcaggtccagctgagtagggcaaatgaagaccctgaacatcctcatgccaatcatgagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctcagcttgatcc

SEQ ID NO: 257897 - DNA, 400 bp, Homo sapiens
gcaacaaacacttgagacttgttgctgccattatcattactgatgttgctgtcgttttattattattattatttagagtgctcagagcaccatatggagcccaggaaaagaaggggaggagagtgaggacaactccatggaggaggcccccgtggaggacctcagggcactggggcagggaccccataagagagaactgcccacaacagtcagaagaacttagctggccttggatcctcaggtgggctctgctgtgtgccctcaggcaagccacgtgtcctctgagcctcagtttcctcatctgtacaacagggccaatatcactcacttcacaggttgctctgggggatcgctgtgcctggcatatagtaggtgttcaataaatgccctgtgactctca

SEQ ID NO: 257898 - DNA, 457 bp, Homo sapiens
tgtgaaggttttttactttgtgagtaacaatagaagagagagctctagagacatgaagccacctggcctaccatctcatcctaacatatgtaggaaaatgcatctcgtttaaatgtgaacaacagaaaaggatttcagttgaatctcatacaagattattacagtgaaaaaagagtagaaacaaccacagaagaggtgaacattgtgtcagataaaaacatttcaaaataaggtaacaaaaaagtagcaacaataatagaaacagtgaaaaaaattataaataaaatttataaacattcagaaatgaaaggattaaaaaagggaagatttgaaaagagaaaaagtaaaacttaggcaagaactggaaataaaagaatattgaaaatgaagacttagttaaaatgagcacaggaatgagtcagcaccatggatactatctgaagaaaaacagatgaaa

SEQ ID NO: 257899 - DNA, 459 bp, Homo sapiens
caaccaaaaggaggggacattgaggcagacagtggtgaggggtggggacatgtggatggaacgagatggccatggactctcctgttgtgaccacttaaaacaggtagaaatacgccccgaggtgggtaaagtgcacagccgactgccaggagggacatggggcacataatctgaacttaaacccttgtagccctgggattctactgaaaatccacccttggacagagtttcaaaacagacattcagcaaagaaggatgcattaagatctcaggttcatcctaaggcccatggaagcacaccaggcctccagggcctgggaaaagacaatagcagagctctgaacatggacaaagctacaacacagtaagaagattacaatatttttccaggctatcatgattttgcaccattttatggttttcagccaacataactcattaaatgtgtaacaaagagta

SEQ ID NO: 257900 - DNA, 539 bp, Homo sapiens
cagaaaaacacacaaagactagttaatcctttgtaaacttctattgccacttctgaaatataaattaaatttttaaaaaattttgtttagaaagtgtcaaaaattgttaataaaaaaagtcactaataggattggaacatgttacttatgttaatagtgcatactttaatgcttaacatcaggttgctataatttaaatgtgttcctcaaagttcatgtgtggaaaacttaatccccaatgcaacagcgttgggaggagaatcccaataaggggtgattaggtcataagggctttgcccttaggaatgcattaatgttgtcattgctagagtgggttaattatcttgagggtaggcttgttaaaaggaagttaaaacccctctttatctcttgctttcccaaattctctctagcccttccaccttctgccatgggatggcacagcaagaaggccctcatcagatacaggcccttcagccttggttttccagtcattagaactgtaagaaataaatgtcttttctttataaattacctaa

SEQ ID NO: 257901 - DNA, 873 bp, Homo sapiens
tccagcccccttaacaaattctatcattagttctgaaaagtgaagaacccttcacttctggaatttccctaaaattttctgatattttgaaacatcaatttcctcctctcctagttttttaccgggaggaccaggatctttccttctcattaattgtccttcattttatgctttgtttcttcatctgtttttaagtaatgtgctattgagtactcttgaaattataatatcattcacataatcttgttaaatagagaaaaataattaacaaatatttttaaccaagtatattgtgtttaaaacaacttctcttccagcatgaagctatacaattggaaacagaaaatatgattttaaagaagaaaataaaagttactgaaaaccatgtgaagcagatcataggaaagatcagtgaagagaggcaggagggcctttggaaatttatcaaggaatttgtaaaatcagaggaaacagaagataacgctcaagtggctgaacaaatggccagtggaaattcttaacttccatgtatgtagcatggatatttgcagatgcatatacattcataaagatacatttcatttcatcagctttaatctctagtaaaattaatgtggtatatgtatcctactcaggatactgaaatacacacatgcgtacacatgattagtttctgttgcatacatatttacaacaatactagttcttaacgtatgttttactttcatttaataatgttcaactttggaaaatacttttgattatttgctaagaataaggaattcagcgctgcttgaatacagctcaaatttgtttatttgccaacacaagtttacatatatgcatttaataaaattttatagtgatttaata

SEQ ID NO: 257902 - DNA, 1137 bp, Homo sapiens
cggccgcgggccacgagagaaagctgcagcaggagctccagaaaatttgcacgtgcagcccccagcagttcaacagactgcacgtctttggaaaagtctttgaagatatttgtaacagttctttgatatttggtgatctcttgaaaaaagttaaggatgaatatgaactctacatggcaacgctcctggagtcccagcctgcagcacagtacgaggctcttctggctcaactcaaggcgctggggcagaggccggtgaagacggcggacatggatctcgccagggaagagctgaggatgctcgtgacagccacaaaagcagccctggagcagaatgatagactcagaagtgaactggagatggaggtggcattgctgcagtctgcaaaggaacgatcagaatcatctgagaaacatataattgatgaaaaccgacttactcttactgagaaggttgaaaagaagaggtgtgaaatactcagtaagtgggatgagatacaagctctggaaaaagaaattaaaacaactttggttcatactggaatttcagatatcactgagaataggattaaaagcatagagcatgaagctatacaattggaaacagaaaatatgattttaaagaagaaaataaaagttactgaaaaccatgtgaagcagatcataggaaagatcagtgaagagaggcaggagggcctttggaaatttatcaaggaatttgtaaaatcagaggaaacagaagataacgctcaagtggctgaacaaatggccagtggaaattcttaacttccatgtatgtagcatggatatttgcagatgcatatacattcataaagatacatttcatttcatcagctttaatctctagtaaaattaatgtggtatatgtatcctactcaggatactgaaatacacacatgcgtacacatgattagtttctgttgcatacatatttacaacaatactagttcttaacgtatgttttactttcatttaataatgttcaactttggaaaatacttttgattatttgctaagaataaggaattcagcgctgcttgaatacagctcaaatttgtttatttgccaacacaagtttacatatatgcatttaataaaattttatagtgatttaata

SEQ ID NO: 257903 - DNA, 305 bp, Homo sapiens
aacgagcctaatggatgaactacaactatgattataatttgcaaggagattagctgccgtgctagccatcgcaggacttaaacaaatgtgctttctcctgctgtttttcaaggtgccttcgtgtaagatattaggtacagtgaaacaattaatagactgatagagctgacttgtaagacaagcttaaagctgaaaaatgtttaaagcgatgtgatcaaagagatagctgcacttgtccctgacgctcgcctgctacatacttcaacctttgtcgaagtaaaatgaatttaaaggtttattacagc

SEQ ID NO: 257904 - DNA, 432 bp, Homo sapiens
ttttttttttttttcttgagatgaattctcactatgttgctctggctggacttaaactcctgggctcaagccagcctcctacttcagcctcccaagcagctgggaccataggtgtgtgccaccatgcccagctagataatttttttaatacgtaaatgtccaaaatataaaaggtgtactcaggcctcagtcctaccccttcatttttattagtttctggtttactcttcctatgtttttttttttgtaaaaatatgtgagtgcatatcaatttccctttattaagtagcataatatgtcttggaagtcaattcatgggttttgctcaccttatttttggggaaggtaaattttgttgacatataacattaaaatgtgtacatgtaagcaaaaagcttggtgaatgtttagaaaatgaatatatctgaataa

SEQ ID NO: 257905 - DNA, 786 bp, Homo sapiens
gtagaggtgggggtctcactatgttgcccaggctggcctcaacctcctgaggtcaagtgaccctcctgcctcagcctcgcaaagtgctgggtctacaggtgtgagttactgtgcccaaccccagtgtgatagaattaagaggtgaggtcttgggggagtgattaagtcaggaggatggagaggaaagtgagctgccttgccccttccaccaggcaaggacatggtatgaaggtgccttcttttgaggcagagaacaggccctcaccagactccaaatgtgctggcaccttgatcttggacttctcacctccaagactgtttttactgtttgccatacattttactgttttcacccagcctaaggtatttttgtagcagcaggaacagactaagacagttactcagccaaggcagtccactgtagtaagagtccatgtatatgaagggcgagaacaggatagaggaacccatggtcagggacccaggacagcaatgacctctccaaggtcccagtgaagcccgtggtcagggtcccagcgacgtcctgtctcgctcagggaggtggtttcatggtggacatgcacacacacctgattgagccacaggttgatgtttggctgtacttaattgtctaggtaataccttaatacagaagtttaaaaactggaggccgtgctgtagctcatgcctgtcatcccagcactttcggaggctgaggcgggcagatagtttgaggtctggagttcaaaaccagcctggccaacatggtgaaacttcatctctact

SEQ ID NO: 257906 - DNA, 368 bp, Homo sapiens
ttttctttcctaagatgggccctggaagggacacccttcgaagcccaaagaatcaaagctactgcaaagcactgctgagagttttgaaagaaatatgaagaaactacatcacgcctggggcgataggctgagatcttcccaaacaggtcagcagttggtctctaaaatattcctgttgccaaggaggcaatgacatcttgtgtaaatcaaaaactaaaaccctaagatatctcatttccattttaaatgcttgggggctaaatatggatgtctagcactcgagaagttcctgtgggattgatttttttcccatcttctctgagccctttgctgagtgtgataagcaggactgcatttcattatcaacc

SEQ ID NO: 257907 - DNA, 462 bp, Homo sapiens
ctggcaagcgcaggctgctacagtatgagatgtaatctgccaaataccacagaatgcaagattttacggattttgaaagaagcaagtgatgattctgtggccacatcaggagagcatgttttctgcatcaataaatctgtgccgaatatgaataaaaaaaaaacccacttggttctacctcaagggctgcttttcaccattgtcccacacataagccagggctggaaaagtacaagagacccggccaggcttgctctcagatctctttgaagtcccccacctgttttcctagctacttggaggccacgatggacttacatttaaactatattagacctcatgcctcagagataggccactgctaagcagcctgagcatttatttaccaattaacttagtccggcattttgagaggtagtgggagagacacggacgcattcaaatgactccccttgagatgtc

SEQ ID NO: 257908 - DNA, 224 bp, Homo sapiens
tatcccaacacttagcatctttataaacacttacgatctcatgcagtgtctgagagtcaggaatccagctgcaggttagctgggtggttctggctcacggtctctggagaagctgcactcaagctctgaaccagggcttctgtcattttgaggcttaactgggagagagaatctgctccaggctcattcacatggtggttagtcggccttgctatgtgttttct

SEQ ID NO: 257909 - DNA, 436 bp, Homo sapiens
aacagtcactgagtgaggcttacagagcgacgctctgtttttcaggaaccaccccctaaaatctccacttttagcagaagactggaaacagaaacatctaaatgttacttggcactgaatgtcttggagtagtctttttggcagtctatcccttgatagactgaaatagccatctttgacaacaaaatgaataaaaagtaaggtttgacctagtcttaattttgatagatccccaaccagtaactttagtgtcacttatttcaaagaaaaggcactctttttttctgctgtgtttttctccatcccatgtctctctctctctctcttttttttttaaaggtttattgtgtttacttttattctttttttatttttgagacagggtctctgttgcccaggctggagtgcagtggggtgatcatggctcactgaaacc

SEQ ID NO: 257910 - DNA, 436 bp, Homo sapiens
ggtggcccctaagaatctgttacccgtgatcacggtgaaacagaaatagatgacagagagcaggggtggtatcttttagaagaaaataggtgaccatctatactgggccagttctatagttagcaagatgacatgggaggagagctatttttctgagctttatgtaacagatgtggttttgtataaatcacacttctgtaaactgaatcctctcttaaatgtactaacggagattgctatttaagggtatcgaatgccaatgtcttctgtgaaatgaataataatctcctaatttggccttagtggcaattcacattttccagaaaaaaatttacttacatcaaggtatacttgtctgagctgagaaactgacttcattcttcacatttccaccatctttattctttgctctcattcttcctttttgttactgttt

SEQ ID NO: 257911 - DNA, 168 bp, Homo sapiens
ccgagttattctccagcttctttgatggacacagaaactggggccctgggaaggggcctacccgggttcatgcagcttagatttcttaactcagattactatttctgccaggccatggtcctgcttgaaattccaccaaagtgagatcttcaaagctctaccaccatc

SEQ ID NO: 257912 - DNA, 467 bp, Homo sapiens
aacaattggacaagaaatatctagacttcagatgattaagtttttagaacaaggtgtataggcattggtgagtggcagacaacaagacagccaactaaaaacaaaatcaggtgtagataattagttctgacattttataatttgtgacaaaatgattttaaaataaagtttatctgtcttagtttgtatcaatgagggagatcccctgaaatgcaaccactcaatccctttgtcagtatttggacaaattaccaaaatatctagccctctaaaggctttaccctatttataaattgtagtttttggcctctgcccagattcggatgttagaaattagcctaaaatctgagtcctcattgaaacagatttaggtagactaactgctgagcctttccaattcacattgctgtaatctattaggtttcattgaatgagacacatgaggatgctataataaaaacctttga

SEQ ID NO: 257913 - DNA, 574 bp, Homo sapiens
acgcgaatagccgtgaataataatatataatgatgcattttatttacgctattgtggaggcagctatgtggagagacacatgtggcacaagatcaagggctgtcaacaaccacatgagtgagcttggaaacagactcccaagttgagcattcagatgagaccacagcccctgctgacagtttgactgcaacctttgagagtccttagccagaggcacccagttaagctgcactaaaatttttgaaccacacagattgtgagataataaatatttgtggttttatgttgtgaggttttggggtatattgccatgtggcaataaatagttaatacattatgtaggtgagaatcctattgtctgatacagtaatatgaagtattgattttcctggtgtgatgtggccattttcaaaaccaatatgtataatgtacacaccctgttgctttaccttcgtcttcaattttcagttcttgcttactcctctttccctgaccttgcacacaaaaaatcatccccactatttttgggattgatctactggcttaaaaaaaataaagctgtacttatcagatg

SEQ ID NO: 257914 - DNA, 609 bp, Homo sapiens
acgcgaatagccgtgaataataatatataatgatgcattttatttacgctattgtggaggcagctatgtggagagacacatgtggcacaagatcaagggctgtcaacaaccacatgagtgagcttggaaacagactcccaagttgagcattcagatgagaccacagcccctgctgacagtttgactgcaacctttgagagtccttagccagaggcacccagttaagctgcactaaaatttttgaaccacacagattgtgagataataaatatttgtggttttatgttgtgaggttttggggtatattgccatgtggcaataaatagttaatacattatgtaggtgagaatcctattgtctgatacagtaatatgaagtattgattttcctggtgtgatgtggccattttcaaaaccaatatgtataatgtacacaccctgttgctttaccttcgtcttcaattttcagttcttgcttactcctctttccctgaccttgcacacaaaaaatcatccccactatttttgggattgatctactggcttaaaaaaaataaagctgtacttatcagatgtaaaaaaaacaaaaaaatgggcttgttgtcctcaa

SEQ ID NO: 257915 - DNA, 748 bp, Homo sapiens
ttcactttgacactaaggcttaccaaggcaaaagcagacaaaataaaggtctttaagaacttaaatgacacggaaactttccaattgcacttcagaataatacattagtcttattgtgacaactagtccttctcatttctcactcacactttcttttttctctgcagcagaaaccacttttattaagtataaatccattctcagtttttgcagtattggccaattgaagggcatctcttcccccaaccaggacctggcccaggggctggcatgtagtggatacaatatgtttgtgtgaaatgaaagaattcaacatagcattcattttgatttactctagatcttttcattaagaaaacattaacggtacaaatgtgagataattataaggaagagaaggtgaagggataccaaataagttttttaaagttatttgtttagataaagttggtctaaaaaataacatgaaactaacaatttttcctttttttattttgagactgagtctcactgtatcgcccaggctggagtacagtggccagtcctagtggtacaatctcggctcactgcaacatctgccaccaggagtcaagtgattctcgtgcctcagcctcccaggcagctgcgattagaggtgcccgccaccacacccggctaatttttgtatttttactagagacggggtttcaccatgttggccaggctggtctcaaattcctgacctctagtgattcacccacctcagcct

SEQ ID NO: 257916 - DNA, 451 bp, Homo sapiens
aagcagagggaagatgacgatgggggaaacacaagggaaaacacagagagaagtaactttgtcacatggctagtaggtggcagggcatgggatgaggagaggctgcagagaagcctcaaagtctgaatgtgagagcagagctagagagagggtgatggaaagttgatgccccatgtgcctggaattacccttcatcaacacagggaatgagagaaggaagagcatgtccaagggatacgatagctcagctttgattatgttgaattgaggtgcctgtagctcatctaagtagagatcagtccagtaagatatacaaaattggaaatcattgatgtgcatttggtagttgaaatctaaccagaggtctttgtaattaagatgtccttggtgatttgagacatgttcaaaagagcagtgtaagatagatgctgctactgcagcggatcaaata

SEQ ID NO: 257917 - DNA, 481 bp, Homo sapiens
ctccagtccatctctacgaagatggaggccattgagctgaaactcagtgagagcccagagcctggcaggagtccagaaagccagatggctgaacatcaggtacaaatagccatgacttcagtttcctacttgattgaataaggcactgttgtgactggttggcctgtcaggcatgtgtttgagacagccaggtgactttttaaaaattttttaaccttatcagttcttccagagtaaacaagggtcctaatggtggtcatttctactactgattcagggagggatctgagaaaaagagagagagggagagagagagagacatgcagaccttgaatctaattaaagaaagctacatgcatttatgttgctttttaactttgattacacaaaatgtgtttccttagagttgccaagttattttgattttgttgtgagccattgttgtaagaataaaatatactccaaatctaccttttctcga

SEQ ID NO: 257918 - DNA, 675 bp, Homo sapiens
gtttatttgtttgtttgtttgtttatttgagatggagtttccctcttgttgcccaggctggagtgcagtggcgagatctcggctcactgcaacctccgcctcctgggttcaagcgattctcttgcctcagtcaccctagtagctgggattacaggcggatgccacgacacctggctaatttttgtttttgtttttgtttttgtttttgagacggagtcttgctctgtcgcccaggccggagtgcagtggcatgatctcagctcactgcaacctcctcctctcaggttcaagcaagtctcctgcctcagcctcccgagtagctaggaccgcaggcgtgtgccaccacgcccagctaattttttgtatttttagtatagacagagtttcaccatgttagccaggatggtttccatctcctgacctcgtgatctaccagccttggcctcccaaagtgctgggattacaggcatgagccactgtgcctggctgagacaaatgttttaacactttggtgtatatccttctacacatatcaaaaatgtgataatatacatacaatttttaacatactgtttacaaacttaacctatcatagacatattaccttgtcggtaaatatagatctacactattttaaattattgcatactttagatgtgccatgctagccccttg

SEQ ID NO: 257919 - DNA, 216 bp, Homo sapiens
acctgcctgttgagagtgcatgtcccagaaagcagccccccttcctgctggacctgcaaggtatgccacccaacttctctctgggaactgtcagtaataaaactgcttctgttattttatgtgttttgttgtcttgcttcctctgtgttttatccgaccaacacacctgaacctaacttctttccaagttagggctctgttagacagtgactatat

SEQ ID NO: 257920 - DNA, 196 bp, Homo sapiens
ttgttcatggaagagccagttttgtttattcatatacaaagtgagtaggcgaagctgagtggggtggcatgtgcctatagtcccagctacttggaaggctgaggcctgaggatcccttaagcctaggagttcaaggttacagctatgagctatgatcacaccactgcctacgcaacagagcaagaccctgtctcga

SEQ ID NO: 257921 - DNA, 651 bp, Homo sapiens
ggtctgggacgccgagagcccggcaacacctcagcccgagcccggcgaggtctctgggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggaga

SEQ ID NO: 257922 - DNA, 531 bp, Homo sapiens
ggtctgggacgccgagagcccggcaacacctcagcccgagcccggcgaggtctctgggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagataaaactcatcagtgctttgaaacaagcagctctgaaccaaagaaatcatttgattcaagtaaccattggatcttcccaaggcaatggtgaaagaaaagaaaaaagcagacaaaaaaggggaga

SEQ ID NO: 257923 - DNA, 542 bp, Homo sapiens
cagcctgaatttgggagactcaagtgcagttggccaagaatgacagtcatgctttttatccacaggggattaggtgtgttctgatcaagctgagagccttttattctcttttccagatccttcccttgctactggcaagatgtatgcatattccggatcccaggtctgttgtcccctcatgccatgtggaagtttcccaagactatagagaaatgtttagatgtgcagatgccacacactaattcttagagtttctacggccattatgactaaagggatttttgtatactgtttaattttttggttgggtctttgtttcacttttttttctaattgagggggaattttaaattgtaaccgttgttacaccgtgagcagacacagtaccttcaagacaacttctccatccttttggttttataatatgtgcatcctaaggcacccttttcaaagttacttaggtgtcaacctcagtgtacaattctacaatgagtagaacctgcatcacagtgaaataaactggtccagctggtatgattcga

SEQ ID NO: 257924 - DNA, 469 bp, Homo sapiens
cagtggggagggggcttcctggtcacaggtagataagagacaaatggttgcattcttctgagtttctgattagcctctccaaaagaggcaatcggatatgcatttatctcagtgagcagaggggtgactttgaatagaaaggaaggaggcaggtttgccctaagcagttcctagcttgacttttccctttagcttagtgacttgggggcctcaagatttattttcctttcacaaaggcaatatttttccaagttaagtatattgtaacaaatttacagttacactagcagtatttattaaaaaacacatttaacataaaaaggtgggaagaacttaatctgcataagggatgatgctctgaattgaataaaattggctctactaaaaaactcaccaaattgcccctttgtgaaccaatgaaaactttatgatgggtagtaaaatttacttccactatgtagaatgactt

SEQ ID NO: 257925 - DNA, 544 bp, Homo sapiens
tctctctctttctgggactaactggttagactgcggctttgcaggccttcttcccacaagtccttgggaaaaggctgaccatgccagccagccagggtggaatcttctagcagtggcaggtgtctccctgccacatctgcccgtttacctggcccggagcttcaagccaccagcactagtttacctaccgcctcccacactggcctctctgaggactttgccccaaagcacgggagggcacagtgggcagaggtgtgtgtggagggccctaaaggccccaacgtgggaagggaagatgggaggatttctccaggatcacagttgtggcagggcagggcagggctccccacagtgcaacaggcttcctgactggctccaaccacgctcctggggggacactcagggcccagagaactcagcaaagttcccctgacttcactgtgcagccaactccactgcaggctgcgtggcgagttgggggaacagcccaagcgggtctgcatccatccaaccttgggcccaagcgcagctggttagcggccgc

SEQ ID NO: 257926 - DNA, 422 bp, Homo sapiens
cgtcgacaaatgataggttttctccctgtgaagcaaaccacttttatttcttaggccatttatccctccttctgagtatcacttataccaatcagcattttctttggttttcgatctgccttcaaactacatcctcaaattgtagcataaatatttcccagttaagtggagtggggctaaaaagaaacaaaggtgacaaaggactaattcagcttgggacatgggagaatggtaatgccatttacccacatggtgtgtagggaaagggaggtaatcaggaaattgttcagtaagctgaaaagtttggttttaggtgcactgggtttcttcacatgcatgtctggtctttgggagacagccaaataaaggatccctacagacagcaaaagattcaggcctggggctttggtgagtgtcgacgc

SEQ ID NO: 257927 - DNA, 432 bp, Homo sapiens
agcatctttagtcgatatttagacagtgaaaaattaatcagtcatgacctctccgatccttcagaacacacccttaggtcactgcctcattaagaccttcaaatcatttatcgaattttattcaggaaatatctttaccttttaaagtaggatgcatgaggtaagaggatgttcctccccagagcaaaaattggcaccattttagggtttttttgtgtgtgcttttaaaaaaatttactttttactttagattcaggggatacttgtgcaggtttgttaaatgggtttattgtgtaatgctgagatttgggcttctaatgatcccattgcccaagtagcaaacatagtacctaatagaatcaataggtagtttttcaactcttgtccctcttcccccctccccccttttggaatctccactgtttattgttc

SEQ ID NO: 257928 - DNA, 557 bp, Homo sapiens
tgagccagttttcattctttctgataaatctgatatggctggttggccagacaatcacaagccattccattgctcagatttattcctgaaagaaaataaaaaggcatcgatccaagatcactggcacatcttaaaagccttgactccaaggccaaacctttccacagagaagtccctcttaccctttttctttctttcttttcccctcttgaccaaggaaggaaggtggaccactgctatttaaaaaatgctagtgaggcaatgaattgtgctctttctaagtactcttggaagcttgattagagccaccttgagattaatggctatgcacagtgcatattttagacaataaattgaattaggatggcttaaacattgcaatgctttaaagcggtattatttttgtgttatatcaagctggttattaggaaaagttaacatgttcttaaaaatagccataagttttggctttatattatagtgttctgctactgttggatatccatgtatagtttgtaagtgcctaaaacataaatgaaataaatgatcaaaacgga

SEQ ID NO: 257929 - DNA, 721 bp, Homo sapiens
gacttctagaaatactaagtcagctctgcaaggttctatgatacaagatcaacaaacaaaagccaagcatgtttctatgtaccaacaatcaatatctgaaaatacaagaaaaacataatatcatttacaatcactccaacaaaaatgaaatactttagctgtaaatccaacaaaacatgcacaggatctctatgctgaaaactacaaattgctaaaagcaatcagagaaaatctaaggaaatggagaggcatactatgttcatgaattgaaagaccaaacatagtgaagataaagactttccctaaattgatctatacatttaattcaattcttgttaaaataacagcatgtttatttatagacactgagagactcattctgaatttttatggaaaagcagaggaccaggaagagctaaaacaaatctgaaaaaatacatccataaaagtgggaagaatcactctacatgatgctaagagttactgtacaggtattagagtcaccagtttgttgttggtggaggaataagcacagtgatcaatgggacagaatagcaaatgaaagatgcaaagaaacatgcccaattaatttttaacaatatgcccacatttccaaaaatggctttgggaacaactggacaactacaagccacaaaaaatgaacgttgatctaaatctcataccttataccaaaaataaccccaaatagatagtagagttc

SEQ ID NO: 257930 - DNA, 143 bp, Homo sapiens
catctccacttctgaacctctaaaatcacaggtcacagtacttgctacagttgcgggggtatcattctttcttctaggttagcaatacagacagtatgttaatctctgggaaacgcattcagcagaacatcagtcatcaaaaa

SEQ ID NO: 257931 - DNA, 525 bp, Homo sapiens
cagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagact

SEQ ID NO: 257932 - DNA, 706 bp, Homo sapiens
catttaatgttctacagaagaaaagaacaaacagagcagggaggcagatgtggccacatactggatctacacttaaaacagtgaatggctgctacccccacctcctgcagtaggaacaggaagaaaggaaggatcacctatagaaaactcaccctgaaaagatgtggagacaggactcaaggaggtcccatttccaaatggaagaagtaaaattttaacaggatgaagtctttgacccgaacctaaatacagaccagaattctgagcccaaaaactatctccagcatccggagaagaagcatcatgaaaggggaggagagagctgtttatatataaaataagttgaatttgcaagaaagaaccgactgtctttttctttaaaaattgtaggtagtatcaaagtttttctcctctttacagataaaaacaaaaaggctaacggaatgcagtcgaccgagaactagtttcttacatttccattgagggtatctttctctagatctgtcatttttcagaattttccaagtaataaagtcacaggcttttttgttaggtggctggaaagagaaatgtatttgtcattctgtctgatcttccaaagcatttttcagtgttgtttttgttgctgttatcttgttgaattttttatcagactattattggtatcaccaataaagaggatgttgaattatgtttctaattccaa

SEQ ID NO: 257933 - DNA, 136 bp, Homo sapiens
attgtttaatcctgtggtatagtagaaagaacagctttgaaatttgataggcctagctttcaatgtaagttctgccacttctggctgagtttcactggataagtgatttaacctttctgtaaaatgggcataataa

SEQ ID NO: 257934 - DNA, 816 bp, Homo sapiens
tctcgggacgcgcgcgattgtgttggtaccgggaatcgcgagccgcgtcgactttccttatgtgtctttgatgatgctaatacctgtctggaattcctttcctccccaattcctattgaattttcaaaatataactcactcctgaggggtcttggaataggtgactttagagcaaattccattcctctgtgtatatttccatcatagtaaccactgaattgaaactgttggcttgtttttctctcccataagactaaaagcaccttgagagcaagggtcatggtctgagttttttcgtatattcttttaaagcacaatattcagcacagagtagatgctcacatatttattgaattgaactgaagcagcttaccttggccttccagcatgcttaaatccttattctccatctattctccttcctcatttaatgtagaatatttcttttcatcttctctttattgtagtatacaagggtttcatcttttgattagtttggatttgtcagctggcttttagtgcagtgataaattccaattacattgccaagcggagaccaggatggacgcaagttagcttcgttggatagtttatatggctagtgatagcctgtaatgatactgtttctttttcatttattcagtgtgcctgaatcaagtgttatgctttctttaccaaataacgaaacttgccaggcatagtggttcacacctgcagtgccaactctttgggaggctgaggatcacttgagcccaggagttcgagaccaccctgggcaacatggcgagaccttgtctctataaagaaaaagaaaaa

SEQ ID NO: 257935 - DNA, 346 bp, Homo sapiens
tctgtatctcactgctgctgtgtgctagttcttcagctctctcaggcactacgtctttatgtagaaatggagtaggactcggtttagagggcagtgtgaggaataaatgagtccatatgaggaaataaccttgcacagtgcctaagttgagatcagggctcaataactacaagctaggttttttttttctatttctatcagtttctatgatgtgtcatagttttatttgttcttcctgtgtgtgcttgttttgatttgtcattattgtacattttgttattgttattattgctgttacccaaataaatgtataattatgaggctattggaaaagttagaaaatgaa

SEQ ID NO: 257936 - DNA, 465 bp, Homo sapiens
ccaccttggcctcccaaagtgctgggattacaggcatgagccacctcacctggtcgatgtggaaggactcttaaagcctggctggggctacgggcctggtggcagtaacagcatccaccttcgttatctttttaaggccagtctgtttttctttttagttgtaacctctgtgcctcacatcgtgtgcttcaccaggagtgtgttatgccactctgccagcctcttctaaggccgcagcacacttcccacttgttggaaggggaactggggaaggacacagcctactgaccccatggccccatttatccccccatccacccctccatctgacagcgtacactgagcatctactatgtgctaggctctaaagaatacagacagaacaagaacaaggcagagacgtttccagtcctcatggcacttccattccaatggagaaagtctggcaataaacaaggtgtgtac

SEQ ID NO: 257937 - DNA, 410 bp, Homo sapiens
gaaagcgggtgagcagctgctcagagctctctagaagtcgtcgttcagcggttctgtctgcagattgtgcagtggaaccttgcagagaagcattgggccagctgagagatttggggttcttggtttctgcattagctctacgtggtcgtgtgtctttgattcagccagtaacctttacttaacgtatttaatagtctgagtaaaatgacaagatttgatgtgtggttgtaacttcttgtggttctcaaaacctagattttaggtatgctgttaggtgaccctactgcattagtttggaaccattcttgactatcttgagctcctctggtatgacacacatatgacctaaaagtatttaaatttgaataatatattttcccgttacttcacttaatgagtgtacttcattt

SEQ ID NO: 257938 - DNA, 513 bp, Homo sapiens
aatcagaaggagtggaccttgcctaggccttgctcaaacacagtgcaaaatcatttataagacaatcagcagatctgaccattgagtagctgtatgataatagaaaggattatagattttaaaaatttgtaatagcattgttgagacagaattcacatactgtaccattcactcatttaatgttcacaattcagtggtttttaaattcagttttgcaaccatcactacaatttgagaacattttcatcacctccaaaaagaaacctcatacctgtcagcagtcatcccccctttcttcccaccctagtccctgacaaccactcatcttctttctatctctaggtttgcctattctggacatttcatatgaatgaaatcatacaatatgtgaccttttgtgactggtttcttctgcttcgcgtaatgttttttgatgctattgtaaatgaaacggccttaatttcatctttggattgttgactgctagtgtatagaaatacaattgatttttgt

SEQ ID NO: 257939 - DNA, 425 bp, Homo sapiens
ataatttcaaaatcctttcagtcaggcaaatttttacactgagtactttttatttggttttaaaacctaatgatctatacgttgctgaacagtttgttctaccctctctactctttcatattaaattgaattaaataaacaagacacatcaatgaaaaatccaaatgtcaaaatggctgatttttagctccctttggctagaaaatatcagtccatggactccttccaggcgtgcattgccagggcattctgtactgaagcagtgagaagtcttcaaatccatctacaaaacactccagaaagcatctcttaactgaggatgtacagaaagacagtacaaactaaagcatgtgtgtaaagatcgggctcagaaatccttttaaaatctagaagtctaagtgctcatattccaagcacgaaggtgt

SEQ ID NO: 257940 - DNA, 472 bp, Homo sapiens
cctcacccgggcaaggagcaccgtgggccctgtcctccagccctcgcagagcctggctgctggcacatgactctccttgtttcctttttaaaaatacctctctgttcctaaactctactcttgagggagatgacagaggtgccgaggtctgaggcaggcaaggctcaatgcacgcaccactcgcagtaccccccccgcccccagaagagcctccacacctccagggtcatgaagtgctagcagaacctccagcccccagggaaagcctgtatttcagaaaaggggccctggtaattatctgggcaaacatcatctcattggggcctggaaggcaacctcctcaacacagttctgattagtaccaggcaaagttcatactcttaagtgctggtccttaacctgaaatctcctaaaaggacaatgaagtgttgcatggatctcctccgctgaaatattaacctgtgcactgaaa

SEQ ID NO: 257941 - DNA, 387 bp, Homo sapiens
tgagatataacctacagttaatttttttaacagaagtttaagtagctcatgttccaattaccactcaatttcttactttggggatatttataagctgattttaaaaggtcatgattagaggtagcctaaatattactggttttaaaataacacaattcttagtttcataaatgtttgttctcttgtctgttagtgtactgatcgaaacatttgaatgcaaaagtaccttcaaagatgttgtcaaaataaacttggaataagactgcaaaaattttgatggagcaactgccagtaatgtatgctgtatgtaaaagctaatttttgctctgtttagaagtttgatgggattaaagaaacattatgggtgacaaagataatgataacttc

SEQ ID NO: 257942 - DNA, 436 bp, Homo sapiens
tggagacccattagaggcattttgcaacccactaataagtttcgaaacccgtggtttgaaaagcactaagcacattatcactcattcagtcaccaaattcttgctgtgccagatactgtacagggcacaggggacacaacactggaaaggacaccgtctctgcccgccgggagcccactgtctgcagtgaaaaacggtgtctcccacaagctgacaaatgctacgacaatgatcctgccctctgtcaataccctttctccgctctctggatagctttttccctaagacgagtggaaaattctcaaacggtttctcagcacagagcctggtctcacaggggcctcctgagggagctcgagttttagatgatggaggcagatcaacagtgaagagatcaagagaggaaatgcagaaactggttctagacctggcactg

SEQ ID NO: 257943 - DNA, 671 bp, Homo sapiens
gcaattcctttgcacagagagaatatgtacatatattttgtcccatcaaagatgacttcaaaagtcctcctccaatttgctttgagaaaaaatagcctttaagctgagattaagaagggaaaaacttccgataaaagggagtatttttcaaaaacttgcaagtgactgcaaagccagttaacacagaaaaccttgtcaccttaagtatgccatttgttatcacacatgccggaatacatctattcatcttcttttaattgcttagctgcgctagaaatacaaagcagctcactgaagcagagactgtgaaagaatattttgtcatggaaactttgaaaacatttcaaagcaggagctcttctctggttaaatgaaaccttctagctgtttcttgggcattgtgtttggctgataagagtctagaacaggtcttctctctgtgtggcttttgcttatatcttcttgtgctcacggatggctgataaaattcctgcaattttccaagtagagtttagaagagtagcaggttattctttcttcctcttctcttgcaaaatgacaagtgagatgatccctgagtaaggaggtaaatactggttaccactctgtgtgtagccaagatgaatcttggggcatttttgaacccatcctccctctgaagaattttgctg

SEQ ID NO: 257944 - DNA, 365 bp, Homo sapiens
gaggttgcagtcagccgagatcgcaccaatgcacttcagccagcctgggtgacagagtgagaccctgtttcaaaaataaataaataaataaaatagaattctgaattttatttttaataattattttctaaaaagaatgtcttgttttctggagctgttgaatttattgaattgacaaaaattatgtacaagagggtacaacatgatgagattgaagtatgtatacattacaaaatggctagatcaagctaaataacatatcacctcccagacttatttttttatggtgagaacacttaaaaaatctactctcttagtgatttccaagtgtatgatatgttgttattaactataggtaccatgtt

SEQ ID NO: 257945 - DNA, 491 bp, Homo sapiens
acgctgctccagagaactctgctctacattgtcagaaaccagctttcaacttgggttccaggatgaagacatgtggaacagaacccgaacttgaacctcagctttggcatccggcttaacctttgccaaggccagcctgcagaacccagccaggagtagctaaaccacagtcaacctgcaaatccatgaaggatatactcagagaagaatcacgagtgccaagagagaccatgaggcaaactgctctccattgaaggtataccagcctacccttcgtgagctaaacacaacctcactcttgccagcattgtaactgactttttaaatctagtaatctgcacttctttgatgccatgaagtcagtattattttcatgtcttggccatcttaagttcctgttttgtgaatattctattcctattccttgttataaaggttttcagagttaagacatgttaaatagaaattattttggaaggttctgtgattca

SEQ ID NO: 257946 - DNA, 396 bp, Homo sapiens
tgttttgaccaatagactgtgaggattaacagtcatattcatattgacttgaagcactgagagacctggcaagtttctgctctccaccagcagagtatgctccaggtagctgcttttccctcttcagcttgggttccaggatgaagacatgtggaacagaacccgaacttgaacctcagctttggcatccggcttaacctttgccaaggccagcctgcagaacccagccaggagtagctaaaccacagtcaacctgcaaatccatgaaggtgaaatacatatttgtgtatataacccactgcggtttggagacaattatgcaacattatcacaacaaaaaacccaatacacccttagaaccatcctgatccacaaattacttcatggagtcttacc

SEQ ID NO: 257947 - DNA, 332 bp, Homo sapiens
aagggtgaggtgtgaggggtcccgtggcccggctcggggtcacttcgccggcagtgacatttttctgggtgccctgcaaggccctcgggcgacttgcctgggagtgctgctcgccaggactacgagcgagcccatgtttgcgcggctctgacccagcccttagtccgcgaggatccccggcggcccggccgtggctgctcctgcagtttctaagagatgggcgggagcaggtgggctctgagtggaggtgagggggtcaggacattttctgctgccattccggcgtctggcacggtgggctgagacttgcgccgcccctttttgggcagggg

SEQ ID NO: 257948 - DNA, 470 bp, Homo sapiens
cccttgcagtggacttgatgaaagcatctcacggaagaaagagctagtgattgtgcatcaaccacttgcaatgtcatttcacggctgcacctgtcaggcaagacacttccacactctgatctcacccctttctctcacctccccaatcctggatgggaccaagccaacagctatggagtgggggtagggccaagacagaataagagaagacactggccatgtcaccccccaactatatgtgttccagactaaggcttgcccaggctgaaggagggaaggtgctttaaactggggaggacattggagttttaatacttggtcagaaagactctcaattactgaaatgagactcttattgttgtgaaaagggaacaggaaagcgatagggcttgctcaggacaagaaataacttatctaggaggaggacttcaaagggcagtgggaaaataaacctgtattctgcttacaaa

SEQ ID NO: 257949 - DNA, 178 bp, Homo sapiens
ggaaagaaatttttttgtgtaagatataagtcttgataaggcttcagtagcaatctgaaaatctcagcagctgaaagcagcaaagttgctttcttgctcaagctaccatgtccaccacaggttggtaaaggggctttgttcattgtggttcactgcgttccagcctagactccatctc

SEQ ID NO: 257950 - DNA, 436 bp, Homo sapiens
aaggagtttgctcagggccacctgagaccacggtggccttcttcccttgaggtttttccaacagtcactcattcgtggaccaaaagcaggccttgcgggaagcttgattctaagggcagtgaagacaggagagcctggggttgagactacaaagcagtgtgagcactcaaggaacctcaagtgaggcaaaggaaagcctgggagaactaggccagggaaggggaattacctgtggctttagggaaagggaacggaagaaggtgcagcttggcagaggggagggcggggagcgtgccgcgtttgccaggcttctcttaccaccctgagttttgctgcttctctcacagagtgacaagtttgatatgaggctccattagataaggggtctggtctggagctgtttaattattctttgatgtgtttggcagattttgta

SEQ ID NO: 257951 - DNA, 533 bp, Homo sapiens
agtggggtcaaatgggatttagaactgcattttcaaacctggtaccttaattctattctaatgaggtacatatttaaaggtaaaattcattaaaattaaaaattcaatctaaaaatttagtttcttagtctcatttcatgtgcttaacagttaccaaactagacaacattggtttataaaaattaccaataattacagtaagtcttgccttagattaaaagctgctctgatcctacttacaaagattaaaagcaagtctaaaagcaacaaactgttttcaaataatatcattatatttcatgaaaaaataaaatatatatattagaatacaaaatattcagcaccccaaaaagtaaaatttacattgtctggcatccaagaaaattctccaggcaaataaagaagcgagaacatacaatccataaggaagagaaaaatagtacaaacagactactatgttcaagaaagctgaagaaaacctatacactttaagtaaggacaaggagatataaaacgtctaacagatcagacac

SEQ ID NO: 257952 - DNA, 108 bp, Homo sapiens
  misc_feature (39)..(39): n is a, c, g, or t
gggtcgacacggccgtgtattactgtgcgagagatccgnggatactatggttcagggagtatcgcttttgatatctggggccaagggacaatggtcaccgtctcttca

SEQ ID NO: 257953 - DNA, 116 bp, Homo sapiens
  misc_feature (116)..(116): n is a, c, g, or t
gggtcgacacggccgtgtattactgtgcgagagatagtttaacagtagagatggctacaattccttacaacactactggggccagggaaccctggtcaccgtctcctcagggagtn

SEQ ID NO: 257954 - DNA, 80 bp, Homo sapiens
  misc_feature (80)..(80): n is a, c, g, or t
gggtcgacacggccgtgtattactgtgcgagagatactactggggccagggaaccctggtcaccgtctcctcagggagtn

SEQ ID NO: 257955 - DNA, 384 bp, Homo sapiens
acagctgcgggtctgagcagaagggcccttaagtactgaacatgctaggactatgaccaggaaatcttaactaaccctgaaagtcgttggctaaatgtaatcattggcactgttctattgtggcgcagtagataattagttctcatctgtggttgtattcttatcagagagttatggagggacctgttatcaccaatcattatgttaatagagataatttatgtgcagctcaaatatcagtgcttggctccctaaggtaagcactctcaataggctctattagtttagtccataagatttattttttctaaccacatttcttttccatgtggtatgtggtgaaaaacagagaaacaataaaacccaagaagtcttaaaaaaaaa

SEQ ID NO: 257956 - DNA, 752 bp, Homo sapiens
tggggcccacccctagagattatgattcaataggcctgcggtagggcccaagaatctgccttttgagcaagttccaaggtgatggtgacactgctagtctgaagccaacatttgagagcttctgatctgtatcagaattattctggctttttcatggttttcttgctttgtgtggttaaagtaatgccacctactggacataattgagaagaactctcagtagaaacttaaaacatttttttttaaatgattaaattctaagggtcctgtcgagagcttgaaaattcttgtccttttgacaaattgggaacagacagagtatttttattgtgacacaagaatatcaacttgtttgtaggatttcttttttaagtaaagaaaacattaaaaatattctcccttctgtttatagttaaatgcataagagcaatactgacactaagtgctgccaattacttgttgtactctcaatttcatgaaagaaaggaacatatcttggtacaataagtgcaaaaattctttctctttggtcctatgtattcatctagacaatgagaaaaggtgagataatctcaacaagtagtctctaatgttctgtgattctgcccaaaagacatttcacttagcttaacctcagaaggagaaagaatctcatttagaatgaaagcctgttctctgacattatacaactctttcattttataaatactaacctatgtgactcttacccctgcagtcatattctgaggtac

SEQ ID NO: 257957 - DNA, 256 bp, Homo sapiens
cagtctatgttttagcaactgttttttaacgtttggttgtgacattttttaacaacagccattgttcaattgttaaactatgtttggatttgaggtctgaatgagctgaattcaaaatatgggactttttattagaaaccctggtaaagtggacactggggaaaaagcccaagatttcatgtgtttgatttattgactatgtgcgtcaacagcctgcttttaattctcagagtaaaataaaaatactcagaatcta

SEQ ID NO: 257958 - DNA, 513 bp, Homo sapiens
tttgtttctttctcttgggggttggctgaatgtattagtttcctggggctgtcataacaaatgactgcaaactgggtggtttaaaaccacagaaatttattatctcacagttctggaggcaagaggtctgaaattcagcagagtcacactccctccacaactattacggggacatctgttccctgcctcttccagattccaatgacttgtgggtactccttggatttcttagcttttggtcatgtcactccaattcttgcctgtaccttcacctggctttttcctgtatgtgtcccaaatctccctctgcctttctaaggtgatttgtcattggatttatggcccacccagataatacaggatggtatcctcatcttaagatccttagttacatttgcaaagaccatttttccaattaagataacatttataacattcacatattctgagaattaggacatgagcatagcatttggggggccaccatttaacccactaatggaacttcttgaa

SEQ ID NO: 257959 - DNA, 244 bp, Homo sapiens
gcagtggcccctgggagtcttcatggctcctctggcagaaagtacctggaggcatcagctcatggacctggagcatatcagcaaggaacagagataaactgtaccgcatcaccaccctggcactactcatgagaaactttcccaaccattatgcttggttgacttggccggaaaggagttaacacacaacatgtgaggagtacactgagtagggagctgtgttcttgggtgacctgtgggtatc

SEQ ID NO: 257960 - DNA, 512 bp, Homo sapiens
acacagtctccaccagcccacctgcttttatggtcaacagccctacctgaatttccaacattgccttttgacccaagaaacacctatcacctgaaatctagggttccagacaggcatcaacaggaaaccactctcttcaatgccctgtcttttctggcccacctaccactgcttctgcagtcacctccactatagtaagcagaccctcttcagacttggcatccaagcctgccttttactctgatgaaatcaacatggataccatgcccatttccccatctgttatcttcctgtctctccctgcaatgttaacagctgtttccctttgaagaacctggcagcccccagaaatccttcctacttaacctctactgcagccctggaacccaatgacagcaccactcaggcagcttttgggaatttgactcccccatgtccacctttggcatctgctatggtttgaatgtgtcaaccaaatttcgtgtattaaaaactcaatccccaaattcata

SEQ ID NO: 257961 - DNA, 691 bp, Homo sapiens
ttcttagagcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaaga

SEQ ID NO: 257962 - DNA, 315 bp, Homo sapiens
gtatctcgttcgaatgagcgattctctaataatacatgatgttgagcatatttcattcgcttatttgccatcaatatattttcctcagtgaaatgtctgttcagatctcctgcccattttttaactggattatttatcttttttttttctttttgagttttaagagttctgtggcgtgctcataccagttctttattggatacatgttttgtaaatattgtctcccagtcttggcttgttttttaaatattaactatgactttcttagagcagaagttttaatttttattaaattcaacttataacattcttcta

SEQ ID NO: 257963 - DNA, 332 bp, Homo sapiens
ctgcctttgggactctctcaaaggtctagccttctgttgcgttttagacagattggcatgaccaacttattctccatctgaagtcaccttagtgtgtatgtgaaatctgtctctaccatgactttgggagactgtagaggccaaatactaaaaagataacaatggtagagtggtagcaaatcaagaaatggcaatcttcaagcagaagttagctaaccatatgtatccctgaatgctgtagaatgagtagagatctttattgatctcttaggtatcttccaagcataaacactgattttaattccttcaaagtaacacgtggaacgccaaaa

SEQ ID NO: 257964 - DNA, 364 bp, Homo sapiens
agggttggtgcctttctggtgtttgagagtgaagcaccctcaaatgggagtgtctgatgacacctgggagaactgggaggcagggagaccaggacaggtgagcccatttctgccaatgggctggtttttgtcccctcaggccaaaccctttcttcaaccagagcagccaggcaaggcttcccagggcagggcagagcagaccctaatatgagctaggttcccctagtgctgatcagtttcctgtatgtagggaaggaagaggatgtcagaggcccatgggccagagagctcacccactctacccttgctccaggtagcgcccctcttggaaatccccgcccccaaacatccttcatccctgaga

SEQ ID NO: 257965 - DNA, 526 bp, Homo sapiens
gagtgtataccctgagttcactcagtcctatttatgctgagttgcctcaggtgccttggtcctatccaaggacagcagtgtgatctctgttttggtacagtgtatttttcttagcctgcaacagacaacttaactatactggctatggttttacagcattatttacctccatgattggtagaatgccttctctgctcactcatctggtttacagtaggccaggttggagttatcacagtagagcaggttaagtgtggtgcagagagttggattttcaaggttagcttgaacttttattactcacagagtggtagttggtttaattagaaaactactcctttgtgggccagttagttttgctttgttctctggccacagactttaccttatgtcaggcacatgatttcaaagatctgcatctatatcaggggtcagcaagggacagcctgcagaccaaagccacccgcagcctccttttgtgtggctggctaggtaagattgacttttaattttataaaggacttta

SEQ ID NO: 257966 - DNA, 430 bp, Homo sapiens
taaacagagttgagaaactggataaataaataaattaattaaattgtcacagggctgagagaataattttgaaaatgcaacttacacttccagtgcagaaacagatcaagggaagtactgcttgcttggtgtgagagggtataccatttggtggtgtgaatatttttttttttattctgccttaaaattgtggatttggaaagggagggcagatggagggagagaggtactggcagattaacctgtgttagaaccttttggccagttacttgtttaatgtgagtaggctttgccctattatctactcaacaaaagctccccaaaacaaaacgatgtggaataaagttacaaggctttggagtgggaataaaactcttaacagtgggtaatttttactggggagaaaaacaaggatcagagaaaatcaagt

SEQ ID NO: 257967 - DNA, 672 bp, Homo sapiens
aataaaatctttattgtaaagaaagttagaagcaagaaacattaacattttttataactacaatttgtataaaagctttctctgtgatctttagtttttctttcttcctctgaaaagctgaatagtgtttaattaaactctcaaaagtatcaagtttttgtctataaaatggcaaaactggctatgatgaaataaactgatatttgctatttctaataaaagcatacaatatatttttctttcttaccagattcaaataatatttaacgccaacatattagtccaagtcctatcatcagtcagatttatcagaaaggtatgaaaacccatgcttactataaggaccaaaatagcctaattcaatactactttgaaaacatggggatgatgttactacgtaattgttttaagtacaataaccactgatcacatttgaactctcaggatacttcaatatttcttttggacaactatgacctgtttagtaaattacccccaaatactttaatatagttttacaaatcgccccaatgccagagacccagatcaaaaagaaaataatggtatgggtcagattcacagaataagcactaacttttatgcaaactgaaaataaagattttatctaaaagttatttggggaaaataagcagactttatcaagaattagag

SEQ ID NO: 257968 - DNA, 392 bp, Homo sapiens
aattataagtttctatccaggttacctcaaagctgtttctttttggtaacatttgttattggaaataattttattgttacagtcttgtcccagtgtgtaatgacatgtgcaaaagggtattcataacagcatcaaaagaaaggggaaaagcatagcagtttatcagtagagaactggataagtgaagttaacacattgtagtggtgtatgccctctagtcattacaaaaaatgaattaggcaggtgtatctgttaagatgtagtaatgtccaggcttgacgcagtggctcacccttgtactcccagcacttcgggaggctgaggtgggcagatcacctgagcccaggagtttgagaccagcctggacaacattgcaaaaccctgtctctgca

SEQ ID NO: 257969 - DNA, 420 bp, Homo sapiens
gcagcagctccaacacatttgcattttagacaaaaagaaggaagaagagggaaggagaaaaagcagcctgccccctcatcccgagttgagttagctctctttaaagagtttttttagatgccccacccgaccacttttgtttctaattcattgcccatacctatcttcaaggaaggctggaaaagttaggactttagctggacacattgccgcccccaacaatatgggggataaaggcaaaggggaggatggatattgggtaattaattagcagtctctcccatggtatgtaaagcacctagcaaatagaaggtactacatgaataataactgttattatttaattcattcttaaagctatttgagggaggctttatcaccaaggctgctgaccagcccggcagccagtgttccctggtc

SEQ ID NO: 257970 - DNA, 297 bp, Homo sapiens
tttttttttgtattttagtaaagtcggggttgcaccctgttgcccaggctggtctcgaactcctgaggtctggcaatctacctgcctcagcctcccaaagtactgggatgacaggcgtgagccaccacacccagcttatgttattcttttacactcccaattgacctgtcatcaattgtaagacatcccaattttagggatgttaaatatgggggttgtgccttttaggattgagcccatcctatctaatacttgggcagctgatacagaatattggtgagggtatatggaattaag

SEQ ID NO: 257971 - DNA, 325 bp, Homo sapiens
gaccttaaatatattctcccaactatttgcatggctggtaagtgtaacatttgcattttctttttaaaccataataaggagaattaaaatcctatgattaagcatttaagataaaatttaagggccatggttattcattaggaaagtaccacgtacttaaaattcaatcagatttcaaatggacttctttttttctatatacaattgcatgtcatagacttgacatttctgtctatcttctgtgtctttccaacgtggtttataagattttattcacacctgtagcattttagggaaggaagaataaatttttccaagtttagta

SEQ ID NO: 257972 - DNA, 422 bp, Homo sapiens
atttaagacaagaaacagagtaatggaggactagaggaacaaaacagtcataaaacttatagaaaacaaataaaatggcacatgttaactgaccttgtcaataattacaataaatataaatgatttaaattctccaatcaagtgatgtaaagtagtaattaacataataatttaataaattaaaataataaggctttttccagaaaaaaagcatttatattcagacataataggttgaaagtaaagtgtgaaaaaatatatataatactaacaagtacgaagcaaaagctgaaatggctatagtgatattaatttaaattgactttaagagaaaaaaatgttaactacagtcaagaaaggacattttatattaatcaaagggccaatcccttaaaaatagaaattataaacgtacttgcacc

SEQ ID NO: 257973 - DNA, 262 bp, Homo sapiens
  misc_feature (11)..(11): n is a, c, g, or t
  misc_feature (67)..(67): n is a, c, g, or t
  misc_feature (72)..(72): n is a, c, g, or t
ggcgaaggctngacccagacggaacagtagcatctatctcccaggtcagggggccaaaggcgccggnccganggcaggatctaggcttacagaaataactcggttaggtattaaaaagccggggggcgggggaagaggctgtaattttatctcttcccgagtgcccctctctttacaatttgggccttacctggtgactatgtgtacttgagtcactcattgtgggccaaacaacctcaagatgcaatttctttcaaaggta

SEQ ID NO: 257974 - DNA, 138 bp, Homo sapiens
ccattgatgcctcttctctagattccgccattcgttaggagttgcaaagctgtggtattctcattctagcattgctcctttccttcttgggaatgcttctgtagagagaaactacctctctccaggatgcttttttct

SEQ ID NO: 257975 - DNA, 2765 bp, Homo sapiens
  misc_feature (49)..(49): n is a, c, g, or t
agtgcagtatctcatggaggtgtttggatgtctcttcctgtggggggtnccaaagcccatgtctcttggcattttctttcagattctatcagccctctctctttctctcctgtctctctctttcattcatacactgagtcattcagagatggcttctctccaactcggagctgcaagtaattctggatctggtcacacacacaaagtccccagagttgccaatttatctagttcatctgtgcctgttcaagatgatgtaactaaacatttaccttcagggaggtgtttccaaagaattttcatcgatatatagaaatcaagagaaaatccatactatcaccaaatcaagagaaattccatactatcaccagttggccaactttccaagtctagtgcagaaatccaaggcacctcacacctagagttcctatacctctgagactccagaggaaagaacaagacagtgcagaaggatatgttagaacccactgaaaacctagaaggttaaaaaggaagcataccctcctgacctataagaaaattttcagtctgcagggggatatccttgtggcccaagacattggtgttatcatttgactaagaggaaattatttgtggtgagctctgagtgaggattaggaccagggagatgccaagtttctatcacttacctcatgcctgtaagacaagtgttttgttccaattgatgaatggggataaaacagttcagccaatcacttatggggcaaagaatgggaatttgaagggtctggtgcctggccttgtcatacgtaaacaagagaggcatcgatgagttttatctgagtcatttgggaaaggataattcttgcagcaagccattttcctaaacacagaagaatagggggattccttaaccttcattgttctccaggatcataggtctcaggtaaaattaaaaattttcaggtcagaccactcagtctcagaaaggcaaagtaatttgccccaggtcactagtccaagatgttattctctttgaacaaatgtgtatgtccagtcacatattcttcattcattcctccccaaagcagtttttagctgttaggtatattcgatcactttagtctattttgaaaatgatatgagacgctttttaagcaaagtctacagtttcccaatgagaaaattaatcctctttcttgtctttccagttgtgagacaaactcccacacagcactttaaaaatcagttcccagctctgcactgggaacatgaactaggcctggccttcaccaagaaccgaatgaactataccaacaaattcctgctgatcccagagtcgggagactacttcatttactcccaggtcacattccgtgggatgacctctgagtgcagtgaaatcagacaagcaggccgaccaaacaagccagactccatcactgtggtcatcaccaaggtaacagacagctaccctgagccaacccagctcctcatggggaccaagtctgtatgcgaagtaggtagcaactggttccagcccatctacctcggagccatgttctccttgcaagaaggggacaagctaatggtgaacgtcagtgacatctctttggtggattacacaaaagaagataaaaccttctttggagccttcttactataggaggagagcaaatatcattatatgaaagtcctctgccaccgagttcctaattttctttgttcaaatgtaattataaccaggggttttcttggggccgggagtagggggcattccacagggacaacggtttagctatgaaatttggggccaaaatttcacacttcatgtgccttactgatgagagtactaactggaaaaaggctgaagagagcaaatatattattaagatgggttggaggattggcgagtttctaaatattaagacactgatcactaaatgaatggatgatctactcgggtcaggattgaaagagaaatatttcaacacctcctgctatacaatggtcaccagtggtccagttattgttcaatttgatcataaatttgcttcaattcaggagctttgaaggaagtccaaggaaagctctagaaaacagtataaactttcagaggcaaaatccttcaccaatttttccacatactttcatgccttgcctaaaaaaaatgaaaagagagttggtatgtctcatgaatgttcacacagaaggagttggttttcatgtcatctacagcatatgagaaaagctacctttcttttgattatgtacacagatatctaaataaggaagtatgagtttcacatgtatatcaaaaatacaacagttgcttgtattcagtagagttttcttgcccacctattttgtgctgggttctaccttaacccagaagacactatgaaaaacaagacagactccactcaaaatttatatgaacaccactagatacttcctgatcaaacatcagtcaacatactctaaagaataactccaagtcttggccaggcgcagtggctcacacctgtaatcccaacactttgggaggccaaggtgggtggatcatctaaggccgggagttcaagaccagcctgaccaacgtggagaaaccccatctctactaaaaatacaaaattagccgggcgtggtagcgcatggctgtaatcctggctactcaggaggccgaggcagaagaattgcttgaactggggaggcagaggttgcggtgagcccagatcgcgccattgcactccagcctgggtaacaagagcaaaactctgtcc

SEQ ID NO: 257976 - DNA, 557 bp, Homo sapiens
aagctattctaaaggggccatttccttcacaagtactggtggattaaatttgaacaataaaatatttaaattatgtaaaacctaatgtgagttcatgtcctttgtagggacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtagggggaggggggagggatagcattagaagatatacctaatgctaaatgacgagttaatgggtgcagcacaccagcatggcacatgtatacatatgtaactaacctgcacattgtgcacatgtaccctaaaacttaaagtataataataattaaaaaaaagaaaatagtcttaattcaataggtagagccagcaaaaaagggcttagttagacacacattctgcaaacctcaaacctcttttactgtcatgcagctgagcttcaaatgacaacctgcctttgagttttgtaatca

SEQ ID NO: 257977 - DNA, 530 bp, Homo sapiens
ctttacaccacctttcctccactgtcttggtcttgctgaaaaccaacattactaacattactgtgcagccaccatgatttgtagctctctcatgatggagtcatctgctctgcccacatctctggaaaaagataatgggcttggccttctcccctgcccctcctgcacctcctgcacctccgacatctctcactcttgagctgagttctgcagggcaagaggaattgtccaggtttgcaaggatgtggggtgtcagaaggaaggaattttggcagaggggtgaacgagggtcaaagggtagatgatggaaacagtgtgatacatttgggacccgagggccatcaggcaagttaggaggagtggtaggaatggagagtgaagggagggagggaggcaggcactcagattactctgctgaagggttgccttgcctttgagtgataaggacctatcagggttaagttccaaagtggtgcaataagataagcatttggaaggattcttaacctctcagacccttagttccttta

SEQ ID NO: 257978 - DNA, 464 bp, Homo sapiens
ttttattacagaactcatattcagagattccagtgtgttaaatagctctaggctaatcttgggccgctctgtgctaagggcaatggttttcatcataggaaaacatttttttttttactccagagatttttttaagctctcccaagtgctcccaacttcctgtctgttcagctgcaaatatcaggcccttaatggctggagagggagagtctatttttaaagtttttactgaatatctccccactgtcaggtgctgaacgaatttggcttgtcattagatctaaaatacccacaggggtttagtgtaacttttaggtatgaaattgatcaggtttgattctgagaccgtctggtgatccttctggaaggccacttgcttgcttagctgtgtgtgagatcataggtcagggctgggctttgttttgcatgggcttttgacattaatttccacaaaagcagcctta

SEQ ID NO: 257979 - DNA, 411 bp, Homo sapiens
gtatcattctcccgacctcacagagaccttttctgaccactctttttttttaaagtacatgcctcctgccccaccttttatatgttctctgtgtttctttcagaacacttgttactatttgtaattgtattaatgtgtatttgtgtgtgtgaattttctctgactcctccaataagcaggaagtctcatgtagatagaaatgatgctagtctaattcatacatttatctccagtacctttgacacaggaagtgtttgataaatatttgttgaacgattaaataaaccattctctttcaaaaaatgcaacttgtgtattctcttttagtctgcctcgttttcttctaaagttagctagtagtaaaatgtaattgtatgttgcagtatttgttttacgaagatgttgacaatc

SEQ ID NO: 257980 - DNA, 464 bp, Homo sapiens
agaaaaatattttggaaaatattttgttgtgtttaatttgatcctgaaaagttgacttaaagaaatactgatccctaaagaaaacttacgatagcagaatctgtagtcagttaattttgatgtggcccaaaacagagtcatttaaataaaaaaaaatcctgataaaatagttttggtgaattaaaaataagagttgatgagctagaggctgggcatggtggctcacatctgtaattccagcactttggcaggccgaggcaggtggatcacttgaggccaggagttcaagacccacctggccaacatacaaaaagtagccaggcatgggtgaggcatgtctgtaataccagctactcaggaggctgaggcaggagaatggcttgaacccaggaggtggaggttgcagagagccgagatgatgccactgcactccagcctgggtgacagagcaagactctgtataa

SEQ ID NO: 257981 - DNA, 271 bp, Homo sapiens
cccccactttaatgtagttccaggattactctgcagagtgaaatccccgatgtctaatgaggcctgaattacttttaaatgtcttctcacattcgttacattcatattctctccttccggtatgaatttttaggtgttctacaaggattgagcttcgactaaaggttgcaccacaatagttacactcatagggtttctctcctgtatgaattcggtggtgctcattaagagatgaactctgactgaaggacttcccacattctttacattt

SEQ ID NO: 257982 - DNA, 617 bp, Homo sapiens
ggtaaagaaagaaagggtagatgaggtgtgccttccacctcacctaaatgaatactgtttgttttttgtttttccttccagattagactttgggggatttcttatatagaataaagggcttgattatatgtagcctctatcctggagaaaggttatgtaatttggactatgtaaaggaagttgacttctttacagcttcgtttcagtatcctaggaggtgggattcatttttctatcttaagttaacctaaaggagagatgccacttgtggtgatggaggttgttaaaaacctgaatttccctgcttcattctccagtgaagagcttaagaaaatgaggctttggatattttggcagaagtgtctgaaatgcacctgatttgccattatacccaccatcaaaagcaacatggccctttgggtattagtgcaagattagcctaagaatagagtagatctctacctggaagagggtgaaacatggctctctactgatttgggttgtactctgaaggccctttgtaatgggtttctgcctctttgtatttcacttaaaaaatcttgatggatatttggcagtctgttaagacctgcttctggcttggagcaggtattgat

SEQ ID NO: 257983 - DNA, 628 bp, Homo sapiens
gcaaaatcagcatagaagggacacagcttagggtaatgaaaaccatctatgacaaacccacagccaacattatattgaatcgggaaaagatgaagcatttcccctgaaaattgtaacaagacaaggatgcccactttcactgcttttattcagcatagtactggaagtcatagtcaaagcaatcagacaagagaaataaataaaagtcattaaattgacattatttctttaaaagaaacatagattcctctccacattttgggacagttaagtacattaagtaatttattaaatttttgttttaattatatgttaacacaagattatatgaaggacaatattgttaacatcatttctatatagttaaaaagcaatatgacacaacatgaagacaagattcttctcatactgtggcatcaattgacaactccatatgacttttgttcaaaaacgtacgtccagaagaacaatgtccctttataggacacaattataaaccatattttacttatttgctttacataaaacaatgtacataatgtatatctgaatttacttttattttaatgataaaatattgttaaaactttgtcactgttattttatatttctatggcatatggtctca

SEQ ID NO: 257984 - DNA, 139 bp, Homo sapiens
attgtgtatgtggttctcagttgacaatggaaatggccccgtaaccttttcctgttggcagcggacagggagaggctctcctggcttcctgcactctgcacacacatgtgtgtacacacccttgctcttgcccagttcc

SEQ ID NO: 257985 - DNA, 455 bp, Homo sapiens
ctttattcccatcctgccataggctactccccatgaggttcctgcaggataaatgtgcacggggggtggtggaggcaggactttggatgcagatccctgagggcctaggactgaaacccccagccctgaactgccctattcttcctatgaaccacagaaagaggcagctcctctcagcctttttctttccatgcccactgttgaatctttgccttcacttttcaaacaagcaaagctgtggctgatgccatgtcctcaaacatgacccattcctatcagcacacccctttagagggcccatcacagacaaggaagaaggcagacagggaggaatatgcttccctgactatcaaaagctgtttcttttccactggaaagaacttactggatcacttctgaaattaattattgtcattagaacagtatttaccaggcattaaatgttagacattatt

SEQ ID NO: 257986 - DNA, 399 bp, Homo sapiens
gaaaagttgtagcatattaatattttggtattatatattcctctatcactaaagaggtaggttttaacctcaatcattcctctttgccattacaaatagagatgacaaattagagtatcaaacaaaccactgtatttaatttacatgtcaagtatgagatcctatcacttatgccaagtcaggtactttaatgtgtttataaaatcattactatgaaaagtaaaagaaatggataatgtccagcattttgacttatagaaaacttgccctgaatctgcaacttctgaagggaaaatactgtcaccattgctaatctcacttgaagcttccacagatttttttgttccaaaagggaagaaaagtgaaattaaattttgaataaagttcataaagaaatgt

SEQ ID NO: 257987 - DNA, 416 bp, Homo sapiens
gcaaaaagaggtactagaaatatctttcatcaatagaattttcctaatgttcctactctgcttagaaacctacagtgatttcctattagcactcatgtgaattacaaacagctcccctgacttctctggtcctgtgacttcttgctttcatcaactcccagcaaacttaactgttggtttctacctaattgtacttcccggtttctacctcattttcaggaagggcacatcagccagtctttgctgcttccctcccttagtcatatggttgctttacctgactcctgggcacagacctagggccttctgaagttttatctttaaaagccatataaaagctcctcttaagggggagtaccaaaagggaggaatagaactctaatttaccattcagtgtctgtgacttgttgagattt

SEQ ID NO: 257988 - DNA, 421 bp, Homo sapiens
agttttagaggatgttgtgggaagttacaagtacagttggccctgtgtatccgtggattccacatctttggattcaagcaaccacagcctgaaaatattaaagaaaaatagatgtttatatctgtactgaacatatacaggcttttttttgttattccctaaacaacacagcagaatttatagagcatttacattgcattattataagtaacctagagatgatttacagtgtacgggaggatgtgcgtgggttacacgcaggcatttacaccagggacttgagcatcctggattttggtatcggggagtcctggaatcagtcacccctgtcccacaaaggaccattgtgttcaactgtttttgatcaacataatggcaaattgtatgactcaatagaataaaaaaagtgcttggaacaagt

SEQ ID NO: 257989 - DNA, 377 bp, Homo sapiens
ctgaaaatatatccctgtgccctaactatagtactatagtataaaattatactatagtataatttttttcacaattacaaaaagcaaaattcaccctaagagtttccacatttgcatatgtgaataggcttaaagattcccccacccccattactaaaatccaatttctgaaattttctcttatgagtcttagaactggacatgggagttcagaaagcctttgaccagtgctagggaaaatatgaatattgcctttgtagttttgccaacactcatattaaggaaatttggaacctagtggggttttagttcacgtaaggagcaagaaaaaacaatcccatcaaaaagtgggctaagaacatgaatagacaattctc

SEQ ID NO: 257990 - DNA, 381 bp, Homo sapiens
aagccctatgtatgtatggaatgtggaaaagccttcactagatccacaggacttattttacacatgcgaattcacactggagaaaagccatatgaatagacgaagtttcatcatgttgtccaggctggtgtcaaactcctgacttcaggtgatccacccaccttggcctcccaaagtgctgggattatggacgtgagccaccacacccgcccttgaaatactgtttctaaaaggtatatggaagaacaataggcaaggataatcaagacccagctgataaaaaaggtggaagaacttgccctaatgaatatcaagattaaaactatagtaattaagatgctgttgcattgtacacagacaactagactattggtacaaaat

SEQ ID NO: 257991 - DNA, 887 bp, Homo sapiens
gcaggccccagagcctgaaaaacaaggtatcaggcagcagagtttaaagatggtgacatagtcagaaagttagtagtggactccttcaaggcaaaaagctgaagaaattagtctgaaaatatgaatataaaaatctatccatacccttggttgacaattaaactataatgtgagaaaggaggacaatgtcttaagaacttaaagacaaaagagaagctggaaagtacaataattatatagagattcagtaggcagagtttggagtttgaatccagaagtttaattttttttgcaacacagaaatcattcttcagaggagattagagaattcagagcttctgtataatgtacagaatccaaaaagagaaattaaacaaaacaacaacaacacacataaactcacaaaaaacactatgcatgtaaggaaaataagaaaatgtgacttatatttaggaaaaaagaagtcatcaaatgaaattgactccaagatcacccagatgctaaaattagcagaaaatgacattaaatcatctgttattaatatgactaaaagctttaagaattatgtgtaaatgatgagaaaaaatgaaaattcccaacatagaaattggttgaaactacaaaaaaagaatcaaatagaaattccacagtggaaaatatcatagctaaaatatcaaattaattgtatgacattaaaagtagattggaaatgacaaataaggaataaatgtacttgaaattagattaatgaatttacttaatttgaaaaagaaagagagaaaagactgaagataaatatcagacttgcagaaacctataggataataataagtagtctagcatatgtgtaactgaagtttcagaagaaaacaaagaaaaaataaaac

SEQ ID NO: 257992 - DNA, 481 bp, Homo sapiens
agaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatggccaggggaaactgagtttcatccaatgtggagaggagcgtttgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccaaactttgtctttttttttttttttttttttttttttttgagacagaatctcaactctgtcac

SEQ ID NO: 257993 - DNA, 545 bp, Homo sapiens
agaggaccagaccaggcagaggaacattttgtttcatatgaactgtggctttgacccccaaactgcaaggaggaacttgctgggccaagctgcagcggcgctgtcttgctggagtggggacctagagtcagagaaaacccacaggctcctctgcccattctcctccatctgcacacgtctcagcctcggaccctcaccactccatggtgaggaaggccatggccaggggaaactgagtttcatccaatgtggagaggagcgttgtcctagagcagggcaactcccaaactgtgacctctgatcatcgtcccttccagcttgctggagtgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccaaactttgtctttttttttttttttttttttttttttttgagacagaatctcaactctgtcac

SEQ ID NO: 257994 - DNA, 477 bp, Homo sapiens
cgcttgcagacctttggagttagatgaccaagactggagagagctggctggaaaccatcagggaagtcaggtgtcgtccagcaggaatagcgagaccacgacatctcagccaagcatcatctctcagaggacccaagccccgcagcctccctccgactccctttttattctcccctctttcctgttccattcctgtgtctcaggccccctgctcatgagccattccacaacagctcctaccattcaaggagcaactgacctgaccgctacacgagcccctaccccgtggtctttgcccgtgccgctttcctgctttggggtacaagccagaagtccttcataggccagatactactatgtcctcccaaactggcgtgtaggcaaagaaattttgttcaagaaagtcactagctgccttggtttctctccaaaattatagagatcataaaacagagatgcttaaaaattcaagggaaa

SEQ ID NO: 257995 - DNA, 705 bp, Homo sapiens
gcgggctgagccatgtggtcatgggccaaggttcacacaggagtgcagagtgatttgcagtcagttgggagtgattacacagtgtttctcatcgataggcaggagggagccttgatgggataatgagatgcagctgatggaaaatcacagctgactgtcgccagtgagcaagctcgcacagccctacagtgctgcagtcgagtcctccccactgcaaagagcaggagaaaaatctgtggaattttaatactaagccaccccacagtgccaagggaaattgactggagggtccaccagttgagtagcagataattgggtaagaacaggatagaggggattcctctggacaaaccacaaaccctgccaggatagggctccaaatagctttcctaaaaagagagagcagcaatgcacaggcagcccctgggaaagggctaaaatgcagggtactaacgcatggggcccctttatcttgcctggccccagcaaaacaaaaagagtttctttgcctccgtgcattacctgtgcagggttagaaactgccaaggagtgttttcctcactgtgctcaatgagagaatctgtttaagctatgtttccatagatcagttcactaagggccaacttgagccctgtttaccctcctgtagtcaacgaaagacagctgtttgcttaaattgaggtctccttcttccatgacagtcat

SEQ ID NO: 257996 - DNA, 429 bp, Homo sapiens
attaattctgcaagcaaggcactggtgtaggtactaagggaacacatgcagcagaacaaacccgaggcactcctcccaaggaacttacagtggaagtcccaagttgtagctgtcagtgcccagtctccaaaactcaaggttattcgtagctctggatgtacccgtccttgctcccttcacattcagacataagggcatcacacacacagggtggcttcggtattccgtcccctttctgccttatctctccaagactttgcatgtgctttggcctctggacagcccagaatggagatgtgcaccccagtgctgcttttatttttgcttgccccacctcctcccgtggaaatgattaagtgttttatctggcatttctgtgattttttggttagttaggattaacttttattaaaagaagaatccatgtct

SEQ ID NO: 257997 - DNA, 259 bp, Homo sapiens
ggaagggtgggtaatggctgagtgtcctaaggaccggggtgctctctcctgaccttccctggactcctgctgtgccctggctgagccagaccactgctgagtgcttgctcactggccacctggagcttctgccccactgcctctgttatcctgtctgcccagcttctgtcctcagttcaacccccagcaccccccttgccctaccacccctcccatgccccaccacacacagacaaatgtcacaggacccactgttcct

SEQ ID NO: 257998 - DNA, 685 bp, Homo sapiens
ccagtccttggaatgaaatgaaatacatgaaagcttcttggacaaaaagttctaatgtgataattcaactgtgagatttctattgatgcttaaaaatccatttgcccaaaatgtaaaaatggaggcagaatatggggactgtggttaattggaaccatctgagtaaactataaattaaagatatataaatatgatttcaggttttatttttaaaaatatcaaaaacaatttcagtccattgaccaacttaaattcagtccaacccaaaccctgcatagcataatgatctgaggtttgtgtataagcaagcaagattcgagtagacattcatctgtgtctttgtatttgcccattacctccacttttagtgttttcccttttccctctctagccaattgtgaaatttctttcattctcctagattgtataaatagcgcatcttctctgaaacctcccagcctttatcccccatcccctgaccttcccctttgcctcccagcaacacagttgtcattctaccctcaatgtgcccattgaatttacccagctgcacttaaaacaactttctcacagtattgtatttccttgtttgcatatccatattatacccctctaccctctctagactataagtgctttgaaatagcatttaactcagcctcgtgtgtgtgtgtgtgtgtgtgtg

SEQ ID NO: 257999 - DNA, 575 bp, Homo sapiens
ccagtccttggaatgaaatgaaatacatgaaagcttcttggacaaaaagttctaatgtgataattcaactgtgagatttctattgatgcttaaaaatccatttgcccaaaatgtaaaaatggaggcagaatatggggactgtggttaattggaaccatctgagtaaactataaattaaagatatataaatatgatttcaggttttatttttaaaaatatcaaaaacaatttcagtccattgaccaacttaaattcagtccaacccaaaccctgcatagcataatgatctgaggtttgtgtataagcaagcaagattcgagtagacattcatctgtgtctttgtatttgcccattacctccacttttagtgttttcccttttccctctctagccaattgtgaaatttctttcattctcctagattgtataaatagcgcatcttctctgaaacctcccagcctttatcccccatcccctgaccttcccctttgcctcccagcaacacagttgtcattctaccctcaatgtgcccattgaatttaccctatagcaccccctctaccccctctagagca

SEQ ID NO: 258000 - DNA, 413 bp, Homo sapiens
caggcccattacgttcattttggagaacatatcagcaaaacacccaagtcaaaataactatagtttgtctgccagttgttctttcaaataaaaacagtgttccatgaacaaaagtgggtagttcaactcaaaatgagtctttgcggctgggtgtggtggtgcacatctatagtccaagagatattctggaggctgaggtaagaggatcacttcagcccacgagttcggggctgcagtaagctatgattgtgccactgcatttcagcctaggcaacaaagtgagacctcatctctaataaataaataagcaaacacacacacacacacacacacacacaacgagtgagtgtcatccttgaaacaatcatcgtatactggtacacagcagaatgtttatttatatttcccatttg

SEQ ID NO: 258001 - DNA, 537 bp, Homo sapiens
gccagcctggctatgcggcccccacctgttcctgctactcgggtgcggccttcacctgccaggcccttccccgctagcttggggcaagcagagttgcatccagtggaaataaagccgttccaggattattgaaaactgagtagcaaccttgggggtcctgggtcatcacatactcccccaaatggaaggtccttctctggcatcaattcccgtctcaaggccccgccttcaacctacggtggtcctcccctgagtaagggtcttcaggctctatcacgctggatgcctaagccttgggagcaacagggcctccttgagaagagccttcccgccgggcagaggagcttgggtcccgaggggacaaggaatctgggttgccctcatccccagagcttgtatatagattataaatatgtaagggggaaaggggtgggttgggaggggttgtagggctggagacccacttcccctcctccccgttcccctggtcccctgtctctggggatgtttgttaacaaagagtaataaaatgattta

SEQ ID NO: 258002 - DNA, 324 bp, Homo sapiens
ggtggagtcttccgcacccagcgcatcgaccttcaccagcaggcctccccaccagatgtcctccgctggatgcctaagccttgggagcaacagggcctccttgagaagagccttcccgccgggcagaggagcttgggtcccgaggggacaaggaatctgggttgccctcatccccagagcttgtatatagattataaatatgtaagggggaaaggggtgggttgggaggggttgtagggctggagacccacttcccctcctccccgttcccctggtcccctgtctctggggatgtttgttaacaaagagtaataaaatgattta

SEQ ID NO: 258003 - DNA, 675 bp, Homo sapiens
gggtgaccctgtctctaaggggtaaaaaaagaaaatctgacacatgctataacatggataaacctcaaagatgttatgtgaagtgaaataagccagtcatcaaaggatagatactgtatgattccacttacatgaggtcctagagtagtcaaatttatggagatggaaagtacaatgttggctgccaggggctggagggagagggcaatggggaattactgtttcatatgaagagtttctattttcaagatgaattctggagatggatgatagtggtggttgcacaatagaaatacttaatgccagtcaatgtacactttaaaatggttaaaatggtaaatgttatgtttatgtgtattttacaattttaaaaaccctattttttaaaataatgcactgaaaccatcagctttacattccttagagcagtggttaacacagccatgacttacttatgcagcatttgcagtgactgttaaccataaatactgctgtatctttgctctagtgtcatgcaatactccaacacaccatcttgagtggcccagaccatcttcactgttaggaaggaaggtctcatttccctgacaagcaatcttcccatccctgtctcctgctggttttatctttccttctctccgcagtgcatcttccttggaaaggaaaaattcatta

SEQ ID NO: 258004 - DNA, 2504 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (1541)..(1541): n is a, c, g, or t
  misc_feature (1589)..(1589): n is a, c, g, or t
  misc_feature (1601)..(1601): n is a, c, g, or t
  misc_feature (1608)..(1608): n is a, c, g, or t
  misc_feature (1611)..(1611): n is a, c, g, or t
  misc_feature (1621)..(1621): n is a, c, g, or t
  misc_feature (1627)..(1627): n is a, c, g, or t
  misc_feature (1637)..(1638): n is a, c, g, or t
  misc_feature (1647)..(1647): n is a, c, g, or t
  misc_feature (1662)..(1662): n is a, c, g, or t
  misc_feature (1681)..(1681): n is a, c, g, or t
  misc_feature (2046)..(2046): n is a, c, g, or t
  misc_feature (2089)..(2090): n is a, c, g, or t
  misc_feature (2106)..(2106): n is a, c, g, or t
  misc_feature (2144)..(2144): n is a, c, g, or t
  misc_feature (2157)..(2157): n is a, c, g, or t
  misc_feature (2182)..(2183): n is a, c, g, or t
  misc_feature (2190)..(2192): n is a, c, g, or t
  misc_feature (2197)..(2197): n is a, c, g, or t
  misc_feature (2201)..(2201): n is a, c, g, or t
  misc_feature (2223)..(2223): n is a, c, g, or t
  misc_feature (2229)..(2229): n is a, c, g, or t
  misc_feature (2264)..(2265): n is a, c, g, or t
  misc_feature (2271)..(2271): n is a, c, g, or t
  misc_feature (2289)..(2289): n is a, c, g, or t
  misc_feature (2294)..(2294): n is a, c, g, or t
  misc_feature (2326)..(2326): n is a, c, g, or t
ancgngnttctacgccgccggtcgccaggagagtgaatacagctagggacgtgaaagaacggggaagataaccgaagggtggtttgagaaacccaccaggccaactgggaattagaattgattcaaaactccattgatcgcctgacctccataagctcctactctgctgcagttgagtgctgccacttaaatcctgcagtcccgagatccggttataaccaatgcatttagatttttcatttcggtggcaacaatcttcattgtaagttctgtcctacagagaagtgtggtgatcaagctcttcggagatactgggactcctctcacaaatatgcttcttagagacaaggcctcactccattgcccctaggccaggcctggtgagtgacagcagccctggtgccccagcctgctagggcaatgtgtcacccagaggcttcaaggcccttctcaccatggtacccacctcctcgaagctgcctcccaaagccctctagctgctgctgcagccacaacaagtgccaccaccaggggccttccagctgccagtgcaggctttccagagccggggactggggaacctgcagtcatcacctcagcaattctggtggcagccaggccagccagggcagcgatgatgaccgtaatgaaaagtgggatgacagctccacactggtggatgagttgagaacaccaggcagaggcatgtacctggtctttgatggttcagtggacctgcactaccattgcagtgcaaagtgcaagagttgaagcttggaaaccttcacctagatttaggaagattcagggaaaagtctggatgtccacgcagaagcctgctgcacgagtggaaccctcatggagaatctctaccagggcagtgtggaggggaaatgtggggttggagcccccacacagagtcccactggagcacttcctagtggagctatgagaagagaaccactgtcctcctgacatcataatggtagatccactggcagcttgcactctcagcctgaaaaagctacaagtactcaaggccagcccttgagagcatctacagatgctaaaccctggaaagccacaagtgtggtgctgcccaaggctttgggagcccaccccttgtaccagcacgcccttgatgtgggataggaggtcaaaggaagttattttggagctttaagatttaatgactgctctgcttggttttggacttgtgtaggcttgtagcccctttcttttggccaatttcttccttttagaatgggaatgttgatccaatgcctatacccccattgtatcttggaagtaacaaacttgtttcttattttacagggtcataggcagaagggactagccttgtctcagataagactttggactgtggacttttgagttaatgctggaatgagttaaatatttgcaggactgttgagaaggcatggtagtttgtttgtttgtttgtttgtttgtttgtttgtttgttttttgagacagagtctccctctgtcaccaggctggagtgcagtggtgcgatcgcngctcactgcaatctctgcctcctgggttcagatgattcccctgcctcngcctccccagtngctgggnctncaggcctccntcaccntgcctggctnnttttttgtntttttgtagagatgnggtttcaccttgttggccnggatggtctcgatctcctgaccttctgatctgcctgcctcggccacccaaagtgctgggattacaggcgtgaaccactgcacgcagccggtagtattttgaaatatgagaaggacatgagatttgggagagaccagaggtggaacaatatggtttgaatctgtgtccccgcccaaatctcatgttgaattggaatccccagtgttggaggtaggacctggtggaaagtgattggatcatggggcggtttctcattaatggtttagcactatccccttagcgctgttcttgtgagagagtttgcatgacatctggttgtttaaaagtgtgtggcacctccccccacacttcctcctgctccagccncgtaagacatgcctgtggccgggcgcggtggctcacgcctgtnntcccagcactttgggnggctgaggtgggcggatcacgaggtcaggagatcgagnccatcgtggctancacggtgaaaccccgtctctactannaatacannnaattngccnggcacggtggcgggcgcctgtngtcccngctactcgggaggctgaggcaggagaatggcgtgnncctggnaggcggagcttgcggtgngccgngatcgcgccactgcacttccgcctgggcgaangagcgagactccatctcaaaaaaaaaaaaaaaaaaaagcaaagacgtgcctgctacgctttcaccttccaccatcattgaaagtttcctaaggcctctccagaagccgaatagataccagcatcatgcttcctgtacagcctttagaaccatgagccaattaaacctcttttctttat

SEQ ID NO: 258005 - DNA, 2583 bp, Homo sapiens
  misc_feature (1620)..(1620): n is a, c, g, or t
  misc_feature (1668)..(1668): n is a, c, g, or t
  misc_feature (1680)..(1680): n is a, c, g, or t
  misc_feature (1687)..(1687): n is a, c, g, or t
  misc_feature (1690)..(1690): n is a, c, g, or t
  misc_feature (1700)..(1700): n is a, c, g, or t
  misc_feature (1706)..(1706): n is a, c, g, or t
  misc_feature (1716)..(1717): n is a, c, g, or t
  misc_feature (1726)..(1726): n is a, c, g, or t
  misc_feature (1741)..(1741): n is a, c, g, or t
  misc_feature (1760)..(1760): n is a, c, g, or t
  misc_feature (2125)..(2125): n is a, c, g, or t
  misc_feature (2168)..(2169): n is a, c, g, or t
  misc_feature (2185)..(2185): n is a, c, g, or t
  misc_feature (2223)..(2223): n is a, c, g, or t
  misc_feature (2236)..(2236): n is a, c, g, or t
  misc_feature (2261)..(2262): n is a, c, g, or t
  misc_feature (2269)..(2271): n is a, c, g, or t
  misc_feature (2276)..(2276): n is a, c, g, or t
  misc_feature (2280)..(2280): n is a, c, g, or t
  misc_feature (2302)..(2302): n is a, c, g, or t
  misc_feature (2308)..(2308): n is a, c, g, or t
  misc_feature (2343)..(2344): n is a, c, g, or t
  misc_feature (2350)..(2350): n is a, c, g, or t
  misc_feature (2368)..(2368): n is a, c, g, or t
  misc_feature (2373)..(2373): n is a, c, g, or t
  misc_feature (2405)..(2405): n is a, c, g, or t
cgccactgcactccagcctgggcaacagagtgagactccatctcaaaaaaaaaaagacacatcaaagactaacaaaccaaatccttacattagaagaagtagtgaaataaagatactaaagatccagactcagtgcacttcaaactttttgaaatagctattctaacagatgtgaggtgacatctcattctggttttaatttgcatttctctgatgattattgaacttgggcttttgttcatgtactttttgctcatatgcatgtcttctttgagaaatgtctatatcaagtcctttgctaatattttatagtatttgttttcttgctgttggactgtttgagtttttatacatttgtgatattaatgcattatcagacgtatagtatagaaatgttttctgtcatgcagatgcttcttagagacaaggcctcactccattgcccctaggccaggcctggtgagtgacagcagccctggtgccccagcctgctagggcaatgtgtcacccagaggcttcaaggcccttctcaccatggtacccacctcctcgaagctgcctcccaaagccctctagctgctgctgcagccacaacaagtgccaccaccaggggccttccagctgccagtgcaggctttccagagccggggactggggaacctgcagtcatcacctcagcaattctggtggcagccaggccagccagggcagcgatgatgaccgtaatgaaaagtgggatgacagctccacactggtggatgagttgagaacaccaggcagaggcatgtacctggtctttgatggttcagtggacctgcactaccattgcagtgcaaagtgcaagagttgaagcttggaaaccttcacctagatttaggaagattcagggaaaagtctggatgtccacgcagaagcctgctgcacgagtggaaccctcatggagaatctctaccagggcagtgtggaggggaaatgtggggttggagcccccacacagagtcccactggagcacttcctagtggagctatgagaagagaaccactgtcctcctgacatcataatggtagatccactggcagcttgcactctcagcctgaaaaagctacaagtactcaaggccagcccttgagagcatctacagatgctaaaccctggaaagccacaagtgtggtgctgcccaaggctttgggagcccaccccttgtaccagcacgcccttgatgtgggataggaggtcaaaggaagttattttggagctttaagatttaatgactgctctgcttggttttggacttgtgtaggcttgtagcccctttcttttggccaatttcttccttttagaatgggaatgttgatccaatgcctatacccccattgtatcttggaagtaacaaacttgtttcttattttacagggtcataggcagaagggactagccttgtctcagataagactttggactgtggacttttgagttaatgctggaatgagttaaatatttgcaggactgttgagaaggcatggtagtttgtttgtttgtttgtttgtttgtttgtttgtttgttttttgagacagagtctccctctgtcaccaggctggagtgcagtggtgcgatcgcngctcactgcaatctctgcctcctgggttcagatgattcccctgcctcngcctccccagtngctgggnctncaggcctccntcaccntgcctggctnnttttttgtntttttgtagagatgnggtttcaccttgttggccnggatggtctcgatctcctgaccttctgatctgcctgcctcggccacccaaagtgctgggattacaggcgtgaaccactgcacgcagccggtagtattttgaaatatgagaaggacatgagatttgggagagaccagaggtggaacaatatggtttgaatctgtgtccccgcccaaatctcatgttgaattggaatccccagtgttggaggtaggacctggtggaaagtgattggatcatggggcggtttctcattaatggtttagcactatccccttagcgctgttcttgtgagagagtttgcatgacatctggttgtttaaaagtgtgtggcacctccccccacacttcctcctgctccagccncgtaagacatgcctgtggccgggcgcggtggctcacgcctgtnntcccagcactttgggnggctgaggtgggcggatcacgaggtcaggagatcgagnccatcgtggctancacggtgaaaccccgtctctactannaatacannnaattngccnggcacggtggcgggcgcctgtngtcccngctactcgggaggctgaggcaggagaatggcgtgnncctggnaggcggagcttgcggtgngccgngatcgcgccactgcacttccgcctgggcgaangagcgagactccatctcaaaaaaaaaaaaaaaaaaaagcaaagacgtgcctgctacgctttcaccttccaccatcattgaaagtttcctaaggcctctccagaagccgaatagataccagcatcatgcttcctgtacagcctttagaaccatgagccaattaaacctcttttctttat

SEQ ID NO: 258006 - DNA, 430 bp, Homo sapiens
  misc_feature (2)..(2): n is a, c, g, or t
  misc_feature (5)..(5): n is a, c, g, or t
  misc_feature (7)..(7): n is a, c, g, or t
ancgngnttctacgccgccggtcgccaggagagtgaatacagctagggacgtgaaagaacggggaagataaccgaagggtggtttgagaaacccaccaggccaactgggaattagaattgattcaaaactccattgatcgcctgacctccataagctcctactctgctgcagttgagtgctgccacttaaatcctgcagtcccgagatccggttataaccaatgcatttagatttttcatttcggtggcaacaatcttcattgtaagttctgtcctacagagaagtgtggtgatcaagctcttcggagatactgggactcctctcacaaatgtatgtctcacagttatgatgaatggtgtatctcctggatcttcctcagttgagtatgttttaaaggaaaaatacactttatcattcaaatctttcaaa

SEQ ID NO: 258007 - DNA, 1552 bp, Homo sapiens
taattgcatcaattctccccgttgcttactgtagcacataaagtgcttcaagatttgtacttcccctaccgttctagcttactttccttccgctcctcacgtgtcctgtattcaagtcttactgaacattctccatcacatctgagacttttcacacctccctcccacacccagcctactgggtggactcaggcatattccctaagacttagttcaaatactaatgactctgtgaaatttctgtctgctttccttcccaaggtaggattaagtgcctctccactagctgccctggtctccaccattctatgtccacacttctaagacagtatgttgttaatactgttttgtagtatcatatattgtagttgtctgtataaacatcttcctttataatatttctcactttatactacttcttcagaaaaaaggattatatattatttcacctttgtagcctgagggcttagcacatcgcctatcatttctatgtagtaaaagaaaactataactttcaggacttagaaaacaacagctattctaagaagtgtctcttgcccaaccagagaaggtataagtctcttaaccagtagtctgtaccattttccagaccctgaggaactgctatactggctattcagtttgtcctacccgttggacaaacattaaaaaacaactttttttcttaagaatcaaactttctgtgcttcccaactccctaaaatgccttaggatttttccacttagatttagtttgcaggttaagttataaatgtctacaaaacaactgctttgcaggaaaatccctgaccccctaagaatgatctctctcactgttccagacagtccattttataaggaagtgacatacctcctcatcagcactcccctcagtatacccaataatacaatcttaactccattattgagagtcaaaagacttgagacgttcaacttatttgagcctacatttccttaactataaaaagacaggtatatgaacaactacctcccagggttattgcaaggattcatttcttaagaacctattatactaagggctggtcatggtggctcatgcctataatcccaacaccctgggagactaaggcaggaggaaggatagcttgaggtcaggagctcaagaccagcctgggtaacaaagtgagacccccatctctacaaaacatgaaaaaaacagctgggtgtggtggcacatgcccgcagtggtggcatgtgcctgcacgtgcagtgcagctacccgagactggggtgggaggatccattgagaccaggagatcaaggctgcagcgagctctgatcactccactgcactccagcctgggtgacagaccgagactctgtctttcaaaaaaaatttttaactaaaaaaattttaaaagaacctaatgtgcacactaggcactgttctcaatcagtgctggtgatgtggcagtgaatgacacaaactccctgatcctgaaaagcttttattttacccagtgtggagttgtgagaaataaatgagcttacccaaataaaatgccagatc

SEQ ID NO: 258008 - DNA, 345 bp, Homo sapiens
tagaggtcaggacctccccctgtaggaatctccagcccccagtactgccccgcacccaggagcacgtgagtactcgtcaactgacataaatgagagtggagatatttcagctgctctgtgtgttctggaggagtgtttcccaaagcacgcagatcacctgaggaatgcaggttctgattttggagtctggggtgagccctgagattctgcatttccaacacgttccggggacggacggggaagggtgctgacgctgcccggcccagggaccacacttggagagcctcggacctggaggacaggaaaaccagtgcaaacgttttctattgcagcttgctgtcacac

SEQ ID NO: 258009 - DNA, 1628 bp, Homo sapiens
  misc_feature (1500)..(1500): n is a, c, g, or t
ctttacctggctcattcatttctcctgtcataaattgataatttcaatgtcctccaattaacccaacacttgggcacttagttcctagacttcctcacttagttcctagacttcctctgattgaatgtcctcatccttcacttcggccttagccatttggctcccatggtcatattctagcctcattgtatctctatagaaatgcctcttccagttctttgcccatttttgaatcaggttggtttttgttgagttttaggagttttctatatattctgggtattaatcctttatcagatatgtgatttccaagtattttatgttgggttgcctttttactgttgataatgtcctttgatgcacaagtttttaattatgaagtccaatttgtctacgttgttgttgttgttccctgctcactcttttggttttataaccaagaaatcactgccaaacccaatgccatgaggctttccttttttttccctttagagacagggtctcactctgtggcctaagctggagcacagtgacgtgatcatggctcactgcagccttgaactcctaggctcaagtgatcctcccacctcagcctcctgtgtagctgggactacaggtgtgtgccattaatttaaaaaaatttttttatagagatggggtctcactatgctgcccagtctagtcttgaactcctgggctcaagcaatcctcccaccttggcctcccaaagtgctgggattacaggtataagccaccacatgctcctcttgagttttatagttttagttctgatgcttaggtctttggcccactttgagttttgcatatggtattaggtaagggtccaacttcattctttttgtatgtggctctctagtttacccagaaccatttgttgataaaactgtcttttcccccactgaatggtcttggcacccctgttgcatattatttgaccacacatgcaagggtttatttctgggatctgtattctattccattggtctatatgtctgtcttttatgccagtactgcactgctttgattaatgtagctttgtaataacctgaaataaaaaaatgtgagccctaaagctttattctcaagactatttcggatatttggggatcccttgaggttctatatgaattttaggctatattttctatttctgtaggaggaaaaagtcatttggatttttacagggattgcactgaatttgtaggtcactttggatagtatcgaaatgttaacattattaagtcttctaatccatgaacatgggatattgttccatttgttttctttcatctctttcagcaatgttttgtggttttcattatacaagtctttgcctcagtgattaatttctaagtattttattctttttgatgctattttaaatggaattttaaatttcttttccatggtcatggtagggtttacacgcagggattgagggtgatgtgatctgccactggtgactgtgatacgtggcantcatggtctggcctccagtaatctttctcttttgcctatgcagtaatttgagcctgctagtgcacctttgatctcactggggacattgcctgttggatcggatttgtcagggtagtcttccgtcctct

SEQ ID NO: 258010 - DNA, 1419 bp, Homo sapiens
  misc_feature (973)..(973): n is a, c, g, or t
  misc_feature (1011)..(1011): n is a, c, g, or t
  misc_feature (1290)..(1290): n is a, c, g, or t
  misc_feature (1330)..(1330): n is a, c, g, or t
ctttacctggctcattcatttctcctgtcataaattgataatttcaatgtcctccaattaacccaacacttgggcacttagttcctagacttcctcacttagttcctagacttcctctgattgaatgtcctcatccttcacttcggccttagccatttggctcccatggtcatattctagcctcattgtatctctatagaaatgcctcttccagttctttgcccatttttgaatcaggttggtttttgttgagttttaggagttttctatatattctgggtattaatcctttatcagatatgtgatttccaagtattttatgttgggttgcctttttactgttgataatgtcctttgatgcacaagtttttaattatgaagtccaatttgtctacgttgttgttgttgttccctgctcactcttttggttttataaccaagaaatcactgccaaacccaatgccatgaggctttccttttttttccctttagagacagggtctcactctgtggcctaagctggagcacagtgacgtgatcatggctcactgcagccttgaactcctaggctcaagtgatcctcccacctcagcctcctgtgtagctgggactacaggtgtgtgccattaatttaaaaaaatttttttatagagatggggtctcactatgctgcccagtctagtcttgaactcctgggctcaagcaatcctcccaccttggcctcccaaagtgctgggattacaggtataagccaccacatgctcctcttgagttttatagttttagttctgatgcttaggtctttggcccactttgagttttgcatatggtattaggtaagggtccaacttcattctttttgtatgtggctctctagtttacccagaaccatttgttgataaaactgtcttttcccccactgaatggtcttggcacccctgttgcatattatttgaacgccaaacgaagccanttgggcgagaaagggggggttatataagctcatatccnctcgggggcgcaaaattccgttggagttagatttaccataagttgttcgccaaggtcctgggggcgttcggtaaggttaccttgggttccaatggcgtaccgttctctgtaaggttgggccgccaaaaggggcttaacccgttgggcacctggcctgttgcagtctaaagtggtaaggcctcttgggtaaataagccgtggaaagttaacagagagacactgggtggaagggccccccgttaaaaaggcccttttttaactttccctttcccaaaaggnaaacgttttttttcagggatcatttttggggatcccttgnaggttctatatggaattattagggctatattttcttattttctgtaaggaggggtcgatttgggattttttacagggcatttgcactgg

SEQ ID NO: 258011 - DNA, 525 bp, Homo sapiens
gcttaaaagcagctccaattatggccagtctgaaatataccatattgatataaattgaaaataaaataattatgctctagttcatcagtattcagagtattaagaatctcaatcacattcagtggttaagggggtgggatattctctattagctcttctatgttttcaggcaaaaaactgattgtggctcagtcttatgaaaagtggaacttttcaaaggaaacttctaacgaagctccttagccatggctgatttctagtccttcgcaatccccaaacaagtcctatacagaaatttttgaccaggcattgaccacaccagtgtcagcatttacataaatatcataattatttcatacaatatgaattagtgtaaaacaccaaatcaaccatgttgtgctgtgctctgttatatcctcatggtttggtagaacctaaggactatgcaatcagtgacaaagtaaaagactgcctggaaaacaaatggtttactgagcaaaagggggtttatttttgatttgcatt

SEQ ID NO: 258012 - DNA, 350 bp, Homo sapiens
gactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgac

SEQ ID NO: 258013 - DNA, 583 bp, Homo sapiens
tacacactcctccccaaaccttttctccccatgcctgacttatctgaggtccacttggactgtttccctgctttcctggccacacagttcatcactcttctatctgtgcccccaaagtgttttcattaaggatgagacctttttttctcatgagctcctcaagggtggggactgtatcatttctgtctccttttttctttctcagttcctgacatttagtgggaactccgtaaataccgtctgaatgaacaaatatctaaaatctgaggctcttgaagtaagtccatcctcggatggatggtttatacttggagacttgcttttgcttctctgtgaatgcatgctcagctgagatctgctggtgcaggtgtttctatagcttccttagcagtggtgggaagcccagcagcttaagatgttagcttctgatgcagggtttactaactctccacgtactctgtccctgagtttctgtttattgtttgcctgtgattctctttggtgccatcccacacggtgttgtcacaaccaaccctttgttttaattgaacgtcctgcgctactcctgctctaactctgacta

SEQ ID NO: 258014 - DNA, 431 bp, Homo sapiens
cttccaagacaaatgaattccagttctgaacactgggagtgcacctgcttgtcggatgtggtgatgggccacatggtggggagtgagggagactcagggcctgtggggcagtcgatgtgggaggactgtcacagagactctcagagggtgcattcagccctgaacagggcaaaggactgcaaggggcaggagcttgggctgacatgcaaggtggctttacacaaggccctttttagagagtgtgattctctgaagcttttcttggcagcttcagtcttgaacctcactggaagggatcctccaaaacatgacccagatggaaagaagtatttctgagtttaaaataactcccctatttggtaatacgggactttatttgtgactttattatttttaggtgtgataatggttttgcagttgtatttaaaaga

SEQ ID NO: 258015 - DNA, 318 bp, Homo sapiens
ttcatctttccccctagtctgtcagcaacacaatctttgctaccaaaaaggggaggggtgtgtgattaagaaaaagggttaaaccaaaaagcatcatcggcacatcactgtcctggaatttcccctgcaacacagactctgaacagggatctgtttacattatctctagatcatcttgacaatatttattctctatttacctaaatgaggcaatatgatgatatttattgctcagaatggctaaatatagacttttcttgagcactcagtaccatagtgggaggctttgctctaatctacatctttaaactgacaagc

SEQ ID NO: 258016 - DNA, 4202 bp, Homo sapiens
gaatgatgaaaaccgaggttggaaaaggttgtgaaaccttttaactctccacagtggagtccattatttcctctggcttcctcaaattcatattcacagggtcgttggctgtgggttgcaattaccatgtctgactcagtaattcttcgaagtataaagaaatttggagaggagaatgatggttttgagtcagataaatcatataataatgataagaaatcaaggttacaagatgagaagaaaggtgatggcgttagagttggcttctttcaattgtttcggttttcttcatcaactgacatttggctgatgtttgtgggaagtttgtgtgcatttctccatggaatagcccagccaggcgtgctactcatttttggcacaatgacagatgtttttattgactacgacgttgagttacaagaactccagattccaggaaaagcatgtgtgaataacaccattgtatggactaacagttccctcaaccagaacatgacaaatggaacacgttgtgggttgctgaacatcgagagcgaaatgatcaaatttgccagttactatgctggaattgctgtcgcagtacttatcacaggatatattcaaatatgcttttgggtcattgccgcagctcgtcagatacagaaaatgagaaaattttactttaggagaataatgagaatggaaatagggtggtttgactgcaattcagtgggggagctgaatacaagattctctgatgatattaataaaatcaatgatgccatagctgaccaaatggcccttttcattcagcgcatgacctcgaccatctgtggtttcctgttgggatttttcaggggttggaaactgaccttggttattatttctgtcagccctctcattgggattggagcagccaccattggtctgagtgtgtccaagtttacggactatgagctgaaggcctatgccaaagcaggggtggtggctgatgaagtcatttcatcaatgagaacagtggctgcttttggtggtgagaaaagagaggttgaaaggtatgagaaaaatcttgtgttcgcccagcgttggggaattagaaaaggaatagtgatgggattctttactggattcgtgtggtgtctcatctttttgtgttatgcagtggccttctggtacggctccacacttgtcctggatgaaggagaatatacaccaggaacccttgtccagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtgaaattgaattccataatgtgaccttccattatccttccagaccagaggtgaagattctaaatgacctcaacatggtcattaaaccaggggaaatgacagctctggtaggacccagtggagctggaaaaagtacagcactgcaactcattcagcgattctatgacccctgtgaaggaatggtgaccgtggatggccatgacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacagcaatttgacacccttgttggagaaggaggaggccagatgagtggtggccagaaacaaagggtagctatcgccagagccctcatccgaaatcccaagattctgcttttggacatggccacctcagctctggacaatgagagtgaagccatggtgcaagaagtgctgagtaagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaaggatgcaactgaagatgacatgcttgcgaggacctttagcagagggagctaccaggatagtttaagggcttccatccggcaacgctccaagtctcagctttcttacctggtgcacgaacctccattagctgttgtagatcataagtctacctatgaagaagatagaaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttgggactttttcaattcctgataaagaggaacaaaggtcacagatcaatggtgtgtgcctactttttgtagcaatgggctgtgtatctcttttcacccaatttctacagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcaacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtgatgatagatggtcatgacagcaaaaaagtaaatgtccagttcctccgctcaaacattggaattgtttcccaggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcacgagggattgctgggattgttttttctttaaaga

SEQ ID NO: 258017 - DNA, 965 bp, Homo sapiens
gagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccagtcctgggcttttcctatggcaagtaactcaagagctgcaggagcagatgttgttaagccagagaggaaacaccaaacatggatccctatctctagcgagtgtgccctgtgactgtggagggtggaggggagtcacgccagagggaggtgctgtgttggggccagaccggagggttacatcctgagcaggagaggagggtcgacgcggccgcgaatt

SEQ ID NO: 258018 - DNA, 1313 bp, Homo sapiens
gagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccaaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggt

SEQ ID NO: 258019 - DNA, 899 bp, Homo sapiens
aaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggt

SEQ ID NO: 258020 - DNA, 628 bp, Homo sapiens
tgtaaaatacagatgagggaatagaagctggtgagactagaaggcaggaagaaacccaaaagagtatgactgtgaacactaaaggaaaaggtgtttgttttcaagaaggaaggagttgaacaagtgtcagtggtacctagaggtcatgtataaggtactgagaagtggaaagtagctattgtgcaatatttaacgaaaagacatccttaatggtcttaatgaaagtagtttcagttaagttatgacaaataaaagccaatgattcaaggaataaatagcaggtgagtaaatagagaaatgaagatgagactgtttttctaagaaggttagtatggggagaggatggaaaatggaagagatagccagtaattggactgagcatggtggctcacacctgtaatcccaacactttgggaggcggaggtaggaggatcacctgaagtcaggagtttgagagcagcctgggcaacgaagtgagaccccatctctaccaaatatttgaaaaggctgggtgtgatggctcacacctgtaatcccagcactttgggaggctgagacaggtggatcacttgagcccaggagtttaagaccagcctgggcaacatggtgaaaccccgtctctaccagt

SEQ ID NO: 258021 - DNA, 284 bp, Homo sapiens
ttctaagaaacctggcattatcagattaaaaaaatttaaacataaaatttgccatgttagccattttgaagtgtacaatttagttccattaagtatattcacaatgttgtgtaaccctcaccactagctagttacaaaactgtttcattgcgaacaaattctgtactcattaaacagtaacttcccattcccccactacttccagcctctgataacctctattctctctctatggattcatctattctggatatttgaatataaatgaaatcataaaatatgtg

SEQ ID NO: 258022 - DNA, 433 bp, Homo sapiens
gaatcacattttatgatgcaaatggccctgggaggaattgtgttccctgtatcccagatcctttctccttttaaaaatctcattttcagtgtcttgcatgtaacattttaaaagttatttttattgtttttgtttccatagagaaaagccttattgtagaagttacaaagcttgcatgaccaaatcacaaaagaaatttagttctaaaaagtaacaaaagaaaatgagggaatcttttaatttttttttttttaagtttaccattggctttggggagaaaaatcacaaaagattaggctacatggtctgcaagccttcaaagagaaaaaacagttcttttaatacaggtctagtaactaattaatattttgaaattttacaatgtgtataatctccagctattacaagaaatagtttattgtgagcctctcag

SEQ ID NO: 258023 - DNA, 532 bp, Homo sapiens
ctctaagtttcctcaacacagctattttgaattctctgtctggaagatcatatatctctgtttattgggattagcccctggtggtttatttagttcactgggtgaggtcatgttttcctgggtagtgttgatgctagtatatgttctttggtgtctgggtattgaagagttaaggatttaatgtagtcttcactgtctgagcttgtttgttcttttccttcttgggaaggctttccaggtatttgaaagtacttatgtgttgtgttctaatctgtatctgtttttgtgggcaacccaagcccagtaacacagtggttcttgcagacttacagaggtactgccttgatggtcttggacaagatccagaaaaattatttggattaccaggcaaatacttgttcttttccctttctttctcccacacagagtctcttcctgcactccaagccacttataggtgggggtagagtgacacaagcagaagaaagagtaatgagcttgaagacaggctatttgaaagtacacagagaag

SEQ ID NO: 258024 - DNA, 670 bp, Homo sapiens
ctgctcttttgtcattgacatcatgtgacactcatcagtgttataataacggaattttgccaatagtttattccatttttctttctccaatcatttataggtccttaacttagtggatgactttacaagcttctcctcagttgtgcaatatttttactttagaatgtgtttgctagaagacatgcatctaaatgatgactgtaatctcttatcctcgggggataaaattaagaagacgtcctgaaaaagttattctcttacttggtcttaaaaaaaacaagtcactagaaatatcactatacaagatctcctgctcaacatcagtaagctgcccttgataaaacaaacgtcctgcatgaaaacattgcctgtctccatgattttaacattatatgtcaaactatagccccaatcaattttctgaaaagtagctaaacaagctgggcgtggtcatgaactatagttctagctacttgggaggctgaggaatggcttgagctctgggcacaagacggcattgcgtgatgatcacgcccatgaatagccactacactccagtgtgggtaacatagcaagatgctgtttctttaaaaaaaaaaatttgtttaaatagctaaaagaatcaaatgcctattataagtagcaaatgaacatgctaagatgaaatgat

SEQ ID NO: 258025 - DNA, 318 bp, Homo sapiens
cagtaggaaaaggccaaatctattccattgaatacaatgacattgttactcttgcttcttgcacaggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctccttccgacccccacccccagctcctctccctttccttttccccctccccctttcctttcccgtctcacgcgccaggccgcttgcacatgcgcattaggtaca

SEQ ID NO: 258026 - DNA, 456 bp, Homo sapiens
ttttttttttcttgctttctttctttctttgaaagacaaggtcggccgggcttggtggctcatcctgtgtataacgcttataattttttaagcactgtttttcttttaaagagccttaggtcctggaggcattgggtgtggtatgttccagaaacagaatattcccataggcctttcatttctattctattggatcacagtgtctacctggggcagcagtcactctgatccccatccacctgcagcgacatctccagggttcactttcacttacaatcacagagggacaccctgcaggatgctatcagtaggggaaaggtcacacagacagaatgctaatcagcttcctcacttttcttagaagaaccctaggagagaattacaagcagaatctacatagaaacaattccaatgccccttgaacagaagagttgaaggagttcagtgcttaaatgt

SEQ ID NO: 258027 - DNA, 531 bp, Homo sapiens
tcccatagaaagggatacaagaggccgaaaggcattccaggccacaagaaagaatagccttttggaaagattcttggttcactttttccccagacacctcccctgcccaggggctgcagggacctctggcttaagaatggccattgctccagctggaagatagcacctggactggctcagggctagacagaggagacggggagcttcaggtggtatcacaggccagataggggatcctgccatgacctatggatgcctcacagagcacttgtctttgtttggatggcttttgaaggtgattattattttgaaggattgattattctaaagggacagacttccctatccctactccgctgcatttacggcaaaataaacttgaaaaagaaaaaacccactcatctgactccagatcctatcagttttccctgtgcctcttcctccagccatggcttagaagggtaaaagttcaagctatctcagatatctgaagaaaagcccactgtccccccaaccctaatatttgtatag

SEQ ID NO: 258028 - DNA, 412 bp, Homo sapiens
ttaaacttgatttggtttggtttagcttagctcctagcattgaatcagtgttgttttctgatttactgcaaccctactctgttgttttgcaactctacagcccttaggtacattataaaacttccatggggttgacctagaaacccaacaatatgacattgttctgtggggaaacacatcctaatctcaattcactgactgataaatgttctagcaggaatacttggctccctaggtgtctgcaccatgctgggcacatagaggtgctccaccccaggacaaagttatttcattgagttggcaaattgaggagaaacaggaattctataagtcattgaagaaatccatcatcgaatgatgcttttttgacaagaagtaatatcactgctgttaataactgtgactccccaga

SEQ ID NO: 258029 - DNA, 471 bp, Homo sapiens
ctactgctgtctatatggctggtaccagtgtcttggtccaaaatgaagaaatgcatgagttattagcctcttcttgaggtttcttagaactttagggcattaaaaagtccttcttcactagtgtataaacatttgtataaacatgcttagtgtataaaaatatgtataaacatgtttagtgtataaacatgctcacttgtctcctatctgaaacaaaacgaaaccagccaacaaaccctaaggctgtttctccacgtcgaatttctctctacccttggcagggcacagtggctcatgcctgtaatcccggcactttgggagtctgaggcgggcggatcacttgaggtcaggaatttgagaccagcgcctgtaatcccagctactcaggaggctgaggcacaaggttgcagagagccaagattgcgtcactgcactccagcctgtgcgacagaggtagacttcatcttaaaa

SEQ ID NO: 258030 - DNA, 235 bp, Homo sapiens
aacaaagaggttgaagtaccccaacatcaagttcagctttctaactttttccagaagggctaataataccactaatgatatgatagtaatagaggcttactatgtgtcagtgtacttccctactctacggttaaagtgcatggctctggcctccaggagagttggagtagggcctctgggagaagagcagaagtgacctgattctaaactcctacagctgatgctgatccttcgt

SEQ ID NO: 258031 - DNA, 386 bp, Homo sapiens
gatcacttgaggccaggagttcgagactggcctgggcaacatgacgaaatcctgtctttacaaaaaaaaaaaaaaaaagttaataaaaaattatcaacaggcagcaagtggtgggaaaaaataaaaataatttaaaaaaataaaaaattagccaggcatggtggtgtgcatctgtaatcccagctgctcaagaggctgaggcaggaggttcgcttgagccaagatttcaagaccagccttggcaacatagcgagacattgtctctactaaaattcaaaaaaattagctgggcatggtggtacatgcctgtagtcccagctacttgggggactaaggcagaagaatcccttgaaaccaggaagtcaaggctgcagtgagccctgatc

SEQ ID NO: 258032 - DNA, 284 bp, Homo sapiens
  misc_feature (27)..(27): n is a, c, g, or t
gatcactctggtagccagtgcagaganatccagtgcagagagggtaacgttggagcaagagaacccagtggggctcctgagatactgcctgacaccagattgtgaggcctgaattaagctggtgacagcagagatggagggcacagatacgaaatatatcaggaagtaaaatcagtaggaatcaataactgctgaaatattatagggagaaaggaatgggggtggcgtgtagtcaaagacggtggtcggcactgatgggccattccacctcccttttgctccag

SEQ ID NO: 258033 - DNA, 365 bp, Homo sapiens
gaatgtgcacgggcgttgtggaagctgagataggagtgctgacctctgcctggcatggctgagccctccctgaaagataattgtgttatgtagataaaacttaatgggttgtgttcattcagcatgtattattatacactatatggttcagtgtcctgaccatactataattttgtcattcgtttctgatattgaaggagcgctaggcactgtgctaagtcatagggatgtaacagtgagcaagagacaccatcccgccatcaggaagcctgtattatgttggaggggtggataataaaacaaagatgtgaaccacatacttacagtgtaagaggtgctttgaaggaaataaagatattcatata

SEQ ID NO: 258034 - DNA, 726 bp, Homo sapiens
gcactttgggaggccaagaagggcagatcacttgaggtcaggagttcgagatcagcctggccaacatgatgaaaccccatctctactaaaaatacaaaagttagccaggcttattggcatgcgcctgtagtcccagctacttgggaggctgaggcaggagaattgcttgaacctgggaggcagaggttgcagtcagctgagatcgtgccactgcactccagcctgcacgacagagcaaggcttcatctcaaaattaattaattaattaattaattaaacattaagaaagcagggtaagtaggtggagagtggctagcgaaggagctatttctgatcataggccggcctttataaaatgacttttcagcaaaaacatgaattaagtcacggtttgagccacgagaagatatatttgaggctgaaggaggaggaagtgccaccaacctgacataggaatgaactggactcagcaaaggagaaggcctaggatggggacagaatgagggggaaattagcaggctatgaaatcagtaaggaaggcaggggcagttccatgtgcagccttacaggtaagacgtcagctgttgtgataggtgtgacaggaaacccatggaggattttaagcagggcagtgacaaactgtgactcacattatcttagcttgcaatagagtctggacttcaggttctgtgactgtcgccctttcttttattctcttgagttgtg

SEQ ID NO: 258035 - DNA, 445 bp, Homo sapiens
taaaattactccatgcttgttgctttttattagtatgaagatttgactgaatactagtcttcatatttaaccttttcccaaactggagatatgaggtgttgggttccctttattctataagcaggggtgcccctcattattatttcaacaattagaatctgggatttatctgtcctggaattcatgtaagagctgagcctccaaaacctgctccgtggactagaaaagcatgagacggtcattggaaagaggatgacctttttgatatacctaagattcagtgcttctcaatgttttaatgactcacgggggcgtctgtgaactgtctgtagaagacgacctttcaaactaatccccccacgggagccctacctagctcacggctgcaggcttcatgtagccccgcgatggctggcaaacagtcacaagctgttgtgttcccctt

SEQ ID NO: 258036 - DNA, 686 bp, Homo sapiens
aagaaatcaacttctgtacttgcattgctgtactttttcagtgggaggaaggtggagttcatatcctagagctgttagagttactccaactaattggtctttattgtgtttcattctttccttgtatttccatgttttattcacttttttcttagcttcttattttctttagattttttaattgacacaataatttctttttttattatactttaagttctgggatacatgtgcagaacatgcaggttcgttacatagccatacacatgccatggtggcttgctgcacccatcaacccatcatctacattaggtatttctcctcctctagtccctaccaccaaaaggtctcggtgtgtgatgttctcctccctgtgtccatgtgttctcattgttcaactctcacttatgagtgggaacatgtggtgtttggttttctgtccttgtgttagtttgctgagaatgatgctttcgagcttcatccatgtccctgcaaaggacatgaactcatcctttttatgactgcatagtattccatggtatatatgtgccacattttctttatccagtctatcattgatgacacattaatttctaaaactcacaagtttattagaagaaaaataatagaaaatatgtgctatataagtatatgggccactttcccctattttttatttttttttg

SEQ ID NO: 258037 - DNA, 339 bp, Homo sapiens
aagtcaagtggctcagtatctctctgtctcactcttgagccaatcaaccctacttcacacaagtcccgaatctaccctaccccttatcttagagaggcacatggagggcagaagaaagaaccaagcagaatggggcttgagtttgggccttgtcacttgctagatgcctgccttcgggataaatccgatgacttctgtatcagtttcttcatcttaaatgagaatcatagtgcaacctcacagggtcattaggaagattagatgaaatcatgcctcttaagtgcctggcacactacaagtacttaataaatgtagctatttttattagggtaataagta

SEQ ID NO: 258038 - DNA, 378 bp, Homo sapiens
cgtgggacaggccctgagcccaggtttgcagcagatgttctcactgatgtcagtacctctaaggttactcccctgggtacaattttataaaatctgtattgagattaaatgttggcgataacttaggtgaagagcttatttcctcatgtgtgcataaattcttcactgaagaagacggaccggaggctgtgctgtggagtacccaaggactgggcttgcttgaatctgacccgactacgccaaatgcctgctcttccttccggttcatgtttatcagctcgtatcaaacacagacccactcatttgcgcacaatcctttcagggaataagatgttgtatttttataattaaaagaattaaaagctataaaacaaagca

SEQ ID NO: 258039 - DNA, 1799 bp, Homo sapiens
atttcttttggatttaagctctggactatagcgcttaacataaacaacaacaagaaaagtatcgtggtagccttgcctatgagcctgcagtttttaatttgtctgagtcctggacctcagcctagatgtaaccttgctctgttgctgtcctctagaggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacagatgaaaagtctggctactagagaacagaatcagaaaaatgctgcctataatcttggagttgctgaagctataagaaaccacaagaatgagaaaccggaattttatatttccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatatttttt

SEQ ID NO: 258040 - DNA, 881 bp, Homo sapiens
agtcagttactactgcctctttatttctgcttttagttgcttttgtcttcctctttgtctccactccctctcctgcccttaactctccagaggcttctggcctcctgggatagttcattgtaagtcctctcaactctctgctgttgttagctgataaccagcaacttaatggttgatctgcctctcaaatactgtctcccaggagctcaacaggtagaggtgtaatccacgtgggaaagcagtcaacagagaggctttggagccactgtctgctggctgtgtgaccttcgcttccaagttgggcctccaggaactccaggaacctgctgatcggcatttgctctcctctcctcagggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatatttttt

SEQ ID NO: 258041 - DNA, 167 bp, Homo sapiens
gctatcatttttgttaccgaactgaacttgggtccatttgtctggtgcagcaaagctaaacattcacatgaggattgcagcaagagaaagtgtgacatttattgcagagcacctcgcaaggagaatctgggagctcgtgcttaaaacccaaattcttggatggcttg

SEQ ID NO: 258042 - DNA, 480 bp, Homo sapiens
gatagacattgtgaagaatgggcagtagtgctaatgtaaagaaagaaagaaggctgcatggatgagggattacattttctgtaggacaggaagaagagatctacagatgtataggtataagctctaagttgggataagcaatgatgtagattactaaacaaaatcagatcatgtgtcttatccactgagttctaccttaatgtttttgttttcatggctatattctcaaaatacctgaatttgtttttagagtcatatatttctttgtcttttcttaattgacagttttatatatttctttcatttctttcttgattaccttgagtttaacatcatgtgctatatgggatgaagaaaaagtatgatgtgttttctacctttaaattgcttgcaatctctttaaagatgctgacagaagaaatagtcactcacaataaagcacaagaaatgattgcatgattcatactttagagttaagag

SEQ ID NO: 258043 - DNA, 717 bp, Homo sapiens
tcatacttctaatcccagcactttgggaggccaaggtgggaggattgcttgagcccaggagtttgagaccaggctgggcaacatagtgagaccctgtctgtacaaaaaattaaacattagctaggcatggtggcaggcacccttacgtagttccagctacttgggaggctataaagcaagaggattgcttgagcccaggagtttgaggacaatttgggcaacaaagcaagaccccagttctttaaattctttttcatgatttttaatacgtatatagttcatcatagagataacgctctgagcttttaaattaatggggcctattgttaaacattttctttagtttcccgtgttagcaatatctttgtgcacatccattattattttcttttgataaatttgtagatgtggactcacggaacaatggaaactccacatggtaaggctttggacagatattgccaaactaatcactagaaaggttttattcattttatacacagatagaaaataatacttcatcataatttgtactaaaattatgatgaaattatcaaaattctaagtttttgttactgttaatataaaaaggtcatcctgctggcagaccagaacactaagaaatttctagatctcaagcagataggaacaagtttatatcaagactccactgaggaactctggtgccaacaagtaaataaactagatttagaatac

SEQ ID NO: 258044 - DNA, 242 bp, Homo sapiens
gccctggaaccctggccagggtcctggctggtttgttcctactggaaaaacacaggctgcatctgcagagggcagtgttgttctggaaaattcctagattgcctcatcgcatctgtttccttcctgggcagggctacagtttctagaaaggtgttagatttgtagcaaatgtagctagagcaactcttaatctgtatagaaggaaaggaggtagcatttcttcttttacaaaaggatgtctg

SEQ ID NO: 258045 - DNA, 345 bp, Homo sapiens
cttccaggtgaaataggcagccatctgactgtactacccaaagtctgcccaaatgaggatttcccttcaccactctttgaaggccactcctagtggattttacaccctgaaaacccctccataaactggagactgaaatcgaagaaatggcatttgctgtgttaatagttgcatacctgtagccagtggctgtactgattttctcagtaaattaccacatctggaaccaaagctacagttgtcatcctcacctgattaagtaggtgataatgtacagttattctccagacttatctgagttttgtacaggcccaacaagctaaataaatggccactatggtaaga

SEQ ID NO: 258046 - DNA, 478 bp, Homo sapiens
catctctcaccacctctccccgcttcctattttatgtaaatgacatgtgttttttaggggaaatattagaaaatcagatttttatttttcattatctcaaactcatacctaggacttatttttttggggtcgggggcagtgtgtctaactgtcacccagactggagtgcaggggtcactgcagcctccacctcctgggctcaagcaatcctcctacctcagcctcccaagaaactgggactgtaggtgtacaccaccacgcctggataatttttttaaatttgttttagtagagatggggtcttgctctgttgcccaggctggtctgaaactcctgggctcaagcaatcctcccaccttggccacccaaagttttgggattacaggtgtgagccaccgcacccagccacctaggacttcttaattcaaataatttactccatccacccccaagactgaaggcaggccgcacccatttc

SEQ ID NO: 258047 - DNA, 521 bp, Homo sapiens
agctgtgtgtatgtatgatacgcatatattcacacgtgtacacatttgtttatattataggggtgtgtgtgtgtgtgtgtgtgtcagtatgaatgtgtgttcatatgtaccctatctctctctccatgaaaaagcatagaggcagcagcactccagttgccataagcacacctggtgctcagatcttggtttataaataatatttctctctaaaggaatcagagctccttggtgaaacagcagatttctgaactagaacaagggaattacaagattagtatggagtaaccttgtactagaaagtaagggggttctcagttaatgatgaaactcgtcaaatggcttaggatagaacatgtctaggaacatttgagcatcaaaacaaataatactaattgagtaaagcaggaatgcatgagcccatgttgatgatgataaaggaaaaataaaatatatggggttaagtggaaatatctttcttaaagtaaaataacaaatataaaagggataatgaaattaga

SEQ ID NO: 258048 - DNA, 702 bp, Homo sapiens
ttttatattttccatgaagcatcatcttttgtcatttcagttctcaccaagcctcccatccagctctacgcatatctacaaaatctccaaacactcttgatattttgcagtcaataacccattcaaatatcaccacttccataaatgctttctcagacttcctcacttaccttccctcctataaaactgatcacccacttgctcctttgtgccacctcaggaccctgcacagagttctgtcacagcacctgtaggatttcactataattgttttgtttagttgtctcccttcctgcagaggttgtacatcattgtaactggccgtagcaggctaatgtgaccccatgaaaacatgttcacattcatgttcatgttcattatatggcaaaagatgtaattaagactttgagatgtggtgtatatcctggattatcccgatggggtctgaatacaattacatgtaccatcctaagagatagggaattttgggacacaagagaagaagcagatgtgaagatgcaacaaagagagatgtggccacaagccaaggcatgccaacagccaccagaaactagaagagtcaaggaatggattctcctacagagtttctggaaaggggggttgctctactgacattatgattttggacttctggcctccagacctcagagcgaataaacttctattgttttaagccaccaa

SEQ ID NO: 258049 - DNA, 781 bp, Homo sapiens
attcctaggtcaaaacaaagcataaacaatcaacgccaacagaaaaatcttccgaagaacaattacaagaagtaactcaggaaattttcccaagaggcaatccagaagagtttgagtttcgatcagcttgtaggactgagacaggagcagaacattgctggaagaaattcacaatacagaccaggatgaagttatttccccaaaagagaggttcgaggcaagtggtcagctccccgttgaaaatcattgtagcagacaaataccgggaatgtaataaattggagaaaagtttgtctctgggcacaaagcctgttgtacctctgagggacaggccaggaaagagagccagtggatggaggatgggtggctgaggctttccatgtgagtcatatctgagtggacatcgggcagttaccagtgggacaaagccccatggatgccatgtgtatgggaagtctttcagcaagaactcacaccttacttggcatcagataattcatactacagagaagccctgtgtatgtattgaatgtggggaaaaaaacacaactcaagccttatacatcatcagaaaattcaccatggatggtgaaaccctatctctactaaaaacacaaaaattatctgggtgtggtggtgtatgctggtaatcctggctactcaggaggctgaggcagaagaattgcttgaaccagggaggcggaggttgcattgagctgagattgcggcactgcactccagcctgggcgacagagtgagactccatctcaaaagaaaagaa

SEQ ID NO: 258050 - DNA, 560 bp, Homo sapiens
gctgtttcacccaaagctcttaggattccttatgtctccccttcccaccttatacttgtttcacccaggaaagagcctctgtcatgcccatcgtctccttccctcctgaaggctcagtatctggttaattacatgacataggaattacttaccatctattttggctatttccatacacattctgagaacaaaataaaagagctcttctccatgcccctctcataatttcttcccatgcccttttttggggaaggcaggccagtcaaagcagtgatggctttgatcagagcaacgagcagatcatgatttattattgccggagtagacagtgggctacattagaggactgcttagacgcatgcttattctagctgctgggagcacctggctgccagttcccaagttcctctccatggggaattgcagctccaaggtggcctcctggagctgcctaactccgccttcactgaaaataaggtgattgaactgtaaagctgaaatcctctgcagtcatgtctcctccagagtcttcaaggtcactcccactttttttctagaca

SEQ ID NO: 258051 - DNA, 614 bp, Homo sapiens
gctgtttcacccaaagctcttaggattccttatgtctccccttcccaccttatacttgtttcacccaggaaagagcctctgtcatgcccatcgtctccttccctcctgaaggctcagtatctggttaattacatgacataggaattacttaccatctattttggctatttccatacacattctgagaacaaaataaaagagctcttctccatgcccctctcataatttcttcccatgcccttttttggggaaggcaggccagtcaaagcagtgatggctttgatcagagcaacgagcagatcatgatttattattgccggagtagacagtgggctacattagaggactgcttagacgcatgcttattctagaaaaggctgaaggaagaaagaaccacccctttccctcctcttctcagctcccttctgctgggagcacctggctgccagttcccaagttcctctccatggggaattgcagctccaaggtggcctcctggagctgcctaactccgccttcactgaaaataaggtgattgaactgtaaagctgaaatcctctgcagtcatgtctcctccagagtcttcaaggtcactcccactttttttctagaca

SEQ ID NO: 258052 - DNA, 577 bp, Homo sapiens
ctacacaaaaattaaacatatttgtatttcaagatgtagcgagctgtcgtggccagttcatggccactttgggaagacatttattaggaggaagcaagatggcactaaagcgtgggagaggacagaagctggagccgtcatgggtgcagaataaggctggcccggaagagtggctgggtggggtcacacctggtagttcagatatcttttgctatcgattttctaattttctaagatgaagtgttaatgtcccagcgtgtggatggtgcctccggatggacaattcaggttgcatgccccagacctcgtgattgggactggccagaacagacaagaccccatcagcaggatggacaagaccccatcagcgggatggaccccatggaaaaaaaaaaaatctaggaactaagacacgattgggcaggaggctgggaaacttactaggaaggatcaaggttgactttgccaccatgacctagccacgaacacgatgggaagaaggctgtggagtggggctgtgggcagtgcctcccggggccctgaatgaagcaagcttggagagggagctggtgtgtgg

SEQ ID NO: 258053 - DNA, 89 bp, Homo sapiens
cagagggtcatccagtgcggacagccctgggggtctggcctccttggtattgtgtcctggaaggaggccctgccagaggcccccagctc

SEQ ID NO: 258054 - DNA, 453 bp, Homo sapiens
gtgctaccttggctgggcagtgaaggttaaggaggatttgagaagtggcaaatgggggaaaggtgttcaggaagagagaacagcacgaacaatgacagtgagctgggaaacaggctggcgtgtttggggaatggcaattaaacaggatggaagaagatggcactagaaagttagcttggggacagattgtatgccaggtgaaagagtttggattttaacctgtcactctgtgataggctgatcacataattcatcatccaaatgcgccacttttgagagttaatgggcatgctacccagatagaataaccaaacactcagcagaaaacagcactgttccaggccaacagaggcatacagtcacctagctttgggaaacctctaaggactaacactcatcaaatttgtttattgtagagggaattctggcagcaatgtggattggaaaaaagag

SEQ ID NO: 258055 - DNA, 282 bp, Homo sapiens
cccatgcgctcagcttcccctgagccaactggagctggagctcattcatctgtcacacccctacactctgcaaggaggaagggtgtggtcctccccattcctcatcgactcttccagggtttatctctgccctcaaaacccacgaaggtggggtgcggtgactcatgcctgttatcccagctctttgggaggtggaggcaggcagattgttggagatcaggagtttgaaaccagcctggccaacatggcaaaacctcttctctactaaaaatacaaaaatta

SEQ ID NO: 258056 - DNA, 393 bp, Homo sapiens
caaactatggttattcagacttgagtccttggcagatactgtcttgaatgaatgaagtgacagtatttgttgccactgataaaatttatgcttttaagattggaattttggccaggcgcggtggcccactcctgtaatcccaacactttgggaggccaaggcgggtggatcgcctgaggtcaggagttcaagaccagcatggccaacatggtgaaaccccatctctactaaaaatacaaaaattagccagacatgatggtgggcacctgtaatcccagctacttgggagactgaggcaggagaattgcttgaacctgggaggcagaggttgcggtgagccaagatggcaccactgcaactccagcctgggtgacagagtgagacttcatctca

SEQ ID NO: 258057 - DNA, 305 bp, Homo sapiens
agcaggacccaaggactcaggcagtggcttttcaggtgtgtgggccgaggactggggagtcggtgaattctggggcccctggggtggccgttcaggaactgcagcagctccccccaccacagatgctcgctgcctactgaagcggccacgtgtttgaatgaagagcagttagaggaacgcttgcaagagaatgtgtttattacctgaggttatgacaatacagaacatacaatgttttctgtggaaaatgtgatactacagaggaaaaggtcactttaattaaatggcaattagaagtaacagca

SEQ ID NO: 258058 - DNA, 359 bp, Homo sapiens
cagatgcacgccaccacgctcagctaattaaaatcctgagctcaagcaatcctcccaccgcaggctcccaaagtgctgggattacaggtatgaaccacttcacccagccagtactggttacttaattgtgataaataaaccatattaatgtaagatattaacaatgagggaaatcgggtgcggggtatatgagaactctctatgctatcatcacaatctttcaataaacctaaaactattcaaaaatggagagtttattttttaaaaattacgcatacaaatatgctttgccagcagggtgcggtggctcatgcctgtaatcccagcactttgggaggctgaggcaggaggatcacttg

SEQ ID NO: 258059 - DNA, 281 bp, Homo sapiens
atataacaacttctagctggattttaaggtacccatcacgctaactaacaaatgacagtgggtcaggatgctaattcacagcacgtcagcacatcaatttgccagaagtttgtttgtgtaaggaaacaacttcataattgttccctcagatactacatgccaaaaagacaccttctataaatccttctacacacgttaactcagtgtcttaaaatgttttgccagatgtttagaaagtacatcaacagcctgggtgacagagcgagactccatcccccccc

SEQ ID NO: 258060 - DNA, 361 bp, Homo sapiens
atcggcaagtctgtcccaggagggcccagaagccacatctacaaggctcactgacctctttggatggaattgaaggaaaacaagctgcaggccaggaatagctagacataagtacaaggtacacccagacaggacctggcagcctctcaaagcagtgtgggccaactgcagaaagccaggcaccagacagcacttcctggagtccgtacctccgtgccatcctatggaaagagaaataggggaagttctctaagtaactcacatccgtgagcgctcctgattgccctctggagagtccaggctgaattaaagaggagctggattcgatgcttgaaaatgaattccgtgctttactttcctc

SEQ ID NO: 258061 - DNA, 742 bp, Homo sapiens
tactggatcccttgggctgcaggaattcggcacgagattatttctgacagacttaaaaatatttattaattgatttaaagtaaacccattacatgttcaggtataacatatttttatgaaaaataattataaaacaaaaacttagtaataagaatagcattattttctatttttgaaaatctacttaatatttcatttcatagtagatgactggattctggattctcattcattatgttgtaatatcccacatcagtagcccccaaaactgcactgcatacactcatgagagaacgagagtagaaaggtaagtaacaacgtagtatcgtgaacatagttttaatgtcgtgaacctcctgaaaaggtctcaggtttcagggtttccagaccacattttgagaaccgttgttctagtggggtttgaaatcagagggacaaaagttgtgcacattttaaatttaaaagacactttcaactgccttccagaataccagtttacactcccatcaccaatataggccaaccccgccctacttctttaccaatgtttaatactttcagagttttaaatttgccaatcttaatggttaaaatgccatctcattgttttagcttgtagttccctatttacactgggatttcatgagacacacatttctgggctcactgtgacacttggcggtgtctggtgactgccccctccctccccagtgcccacctttttctttggcctgggatgttt

SEQ ID NO: 258062 - DNA, 483 bp, Homo sapiens
ggaggggattcttcagagttccctgtaactagatgacatttcacttattacagctgatataatattttttattatcacttatgtttttagattttcaaagtttcttcctttgtaaattcttacatcatattcctgttctcttaaaattctacaatttaacacctttaatgttacttctattatagctttttagcacctccttttatgctcgccaatatgtatacgattgtgaaagtaaaacttggcaattactgagttaatgtgatgtgtgtagaggagacagactacaccacctgatttgatttcaaaatgaatcttcatttagtcctcaaagagttattaaatgatgctgttagtcactagttattgaacagcggcttattttcttgaaatgtattcagaataagattcttttctcaaatatttcatttaattaggttctttgatagtatttgctttaaataaaatgttttcaaattaaaa

SEQ ID NO: 258063 - DNA, 5027 bp, Homo sapiens
aaagcgacaccttctacgctgggtggccagtttccatgtggcttggtgtgggagcagagacgggacagtggggcctgtccttgttcatccactccctgcctgtgctggttgcagcctcagagcaggcgggagatgttcttggggcttaggctcctggcagagcacatagcaggagtttgtggggtctgaggttcctgtcccagggttccccgattctgtgcctggcctattaatctttctctggggagcccagtgcccactgccgagcaggctcctgccatcccccatgggcgggtgtgtctgaaggagaatgggatcccggcacggtcttggtttctaacatctcggggtgtgttttggaggcaggcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagacggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccagatcgatactgccggctgcttggaggtcgtccgagagaggaaggccctgccacccaggctgccccaggctggtgctcgggacccaccagtgcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcagcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258064 - DNA, 1847 bp, Homo sapiens
aaggaggaagctggttcctggcctgcccagttgcgtgtagattctgcagaagtggcctccctttggggcagtgtggaaaaggggagaagagaggcctcattctcgtgcaggagcctccggccatcctgatgctgcccagccaggtggccttgtctgagcgagaagctctgggatggacgctgacccggctctgagccgcacacgccacacacacgtgtgctcccagggtgggccatgggcacagtggagggtggtggctgtgtttgtctctggatttctggggtcccaaaggtccctctctgctgtcacctctctgagtgtccttggggagagttttccaatctctgtaggtgaaaccatgtttggaaccctggaaagcatgtggagctggggcccccagagaggcctcctcccctggtgccagggtgcccacttgcagcagctgggaggctggcctccctgagaaaccaccagaagcaggcagcctcagctggacctgtgggcctgtcatagggagtgtggcagagggccttccatctctccccagggttgtgtctcgcaagtccctgggctgaagtgtgggaggaagcaatgtccaagagttggggaggaccccggccagccaggggaagaggccctctgtgccccatccatgtacagcctcctgccctgcctgggtgtgatggctgtcccatgggggagtgggaggcccaccagagggatggcttggatggggtcagagcccccgagggagggagtgcacagtcacgtgtggccccaggagtgcctggagcagctcccgcctgagctgagggtgccctgtcccaagtgggacactcacccacagggcccctcctcactcccgtcccttccccgtccatcatggctcgggggtgtcactcttgtccccactgcctggattttctttcagggagccccagactctggtaaatgctctgcttcctcctgcctggatacttctaatgaccctgacgacctggacgtgctcagaacccggcatgccaggcacacccggaagcggaggcggctggtgtgagcagcaggtgagtcctgagtggggaggccactgccctacaacccaggggacagagtggtgtccagatggcagggggccttggcctctgctcggctctttggcgctcacagcaggtgtgctgggttaggtgggcaggtccagggtcatggaggccctccagggggagaagcatttaacccacatccttcctgctggccacccatgcctcgggccttggcaccactgtgcccctgaccataggctcattccctgcctttggggtctgggctcctccctggccgctgtgctctggtggtgccctgttcccgtgcattgctgcgtcgtctcccagcttgtaaaacgatcaccatccccaaccgcagccaccaggctggctcttcactgctggagccctggtgccctggcctggcccttggcgcatgtgggtcaggtttaccaagcagactgggcgtggccggcgctggggtggtcttggttcctgtttgtctgtcccagccctgcttggggtctggctggggtcaagggcaccccccacctggtgttcctgtgttccaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258065 - DNA, 461 bp, Homo sapiens
gctaacggtgctcgcgggtggatgctttggttttgttccagttgggcagggccccagtcagcctccagcagggagagccacgccaaggacgggggagggcgtttctctttgttgttgggtgttttgggctcccgggtctgtgctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258066 - DNA, 3308 bp, Homo sapiens
agtctcctagaacagcaagcctgtcctggggaagaatctttggatgaaggcatttcgcatggggttggctttgcaggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccagatcgatactgccggctgcttggaggtcgtccgagagaggaaggccctgccacccaggctgccccaggctggtgctcgggacccaccagtgcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcagcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258067 - DNA, 2352 bp, Homo sapiens
tccccctgtgcccgcagcggatggcctcagggagcagctgcagcaggcccgcctggccagcacccctgtgtttaccctgtttacccagctgttccagatcgatactgccggctgcttggaggtcgtccgagagaggaaggccctgccacccaggctgccccaggctggtgctcgggacccaccagtgcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcagcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258068 - DNA, 2319 bp, Homo sapiens
aacttacaaagagctcatacaggccgggcatggtggctcacgcctgtaatcccagctgttccagatcgatactgccggctgcttggaggtcgtccgagagaggaaggccctgccacccaggctgccccaggctggtgctcgggacccaccagtgcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcagcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258069 - DNA, 4572 bp, Homo sapiens
aaagcgacaccttctacgctgggtggccagtttccatgtggcttggtgtgggagcagagacgggacagtggggcctgtccttgttcatccactccctgcctgtgctggttgcagcctcagagcaggcgggagatgttcttggggcttaggctcctggcagagcacatagcaggagtttgtggggtctgaggttcctgtcccagggttccccgattctgtgcctggcctattaatctttctctggggagcccagtgcccactgccgagcaggctcctgccatcccccatgggcgggtgtgtctgaaggagaatgggatcccggcacggtcttggtttctaacatctcggggtgtgttttggaggcaggcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagacggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccagatcgatactgccggctgcttggaggtcgtccgagagaggaaggccctgccacccaggctgccccaggctggtgctcgggacccaccagtgcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcagcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 258070 - DNA, 503 bp, Homo sapiens
tgaagtggtgtcttgtggttttgacgtgcgcttccctgtggctgatgtggagcctcttttcatgtggttggtgactgttcatagaaataggtttttagagaagtgtctgttgaagtcctttgcccatttttgacattacttgtctagttatgactgacttgtaagagttcttcatatgtttcagatataagtcctttatcggacacgtgacttgcaaacgttctctcccagcctgtacactttctacttttttgatggtgtcctttgggacacaaaagctttagcttttgatgaagtctactttatctgtagttttcttttgttgcttgcgcctttagtgtcatatccaagaaaccattaaagaagcttggggcagcagcgggcggcgtctcggcatctaaaacgttctttgcttttcatgtcacgttcaggtatctcaggagattacatttcagcttgaaaaagggtcggtggaatttaaaagaagaggaacagttaattga

SEQ ID NO: 258071 - DNA, 445 bp, Homo sapiens
gttgcaaagcccctgctgtggccagttatgaagggtgcctatccctgcccctgcttctgtcacccagaggccctcccagggaaaggagaatacatgcccagctcttgacacaggcctggtgagaattcaatgtctgaccatcagtacgtcccaggcccacgttcgcatcaaatcgtagaactactgggaggactctcagaggtgtcgtgttaactttcagcgactccccctgaaaggaggctgatttcttcatcaaagcccccagctgaggcttgctgagtggggaagctgtccctgcctgcatggggtctggagctgctttggtaaatggccaaactgtcggcctgcattgagactggccactggacagcctggatacaaaacatgctgttttgtttgttttgtttacctttgaaacaaattaaaacaattaaggctagattta

SEQ ID NO: 258072 - DNA, 412 bp, Homo sapiens
aaggagggcccgccatctcacggcaggtgaagaagacaaggagaaaaagaggccatttttttcctctgatgagcagtacccactctcttatagaacaatccgggctatgcctgggggcctactggttaatcccatcctgtatgggaaatacagaaagaatatcgagcctggaacaaaactgctacaatttattactccctcacatttacctgtatgcactacctgactgaccctcacagcaacttcacacaatgtggactgctaattccactttgcaagtgaagaaactgaggctccgaaaggcggcaaccgcagaggtggatctggttcctgtttccaggcctttgccccttctgttccctcttgtggccagccccccgaaacactaaaaatggaaataactgtcattact

SEQ ID NO: 258073 - DNA, 420 bp, Homo sapiens
cagggagtggcagcctggtgcctgggaggacacacggatccctcaaaacactggagttagcctgtggaaccggcctcttggatctccagcccccaattcccatgcaagtctggcctgcaggttaatggtgctacatcagactcttctgggcagtgcactctgccagccctaaggcactggggagccctggacagacaatggcaggtaaaatgaacaatgagcacctccctaacacaaagacaagcaaaatcacacactgcaggagtccctgacgggctacccaagagaaagtgtgctgcagccagaggaaatagtgccagtcacacacagaagggaatggcagattgcacatctagaagtgagcaggtgtctaccatgcttaaagtgaaaaaaactgctaattattgtaaagggtgtaga

SEQ ID NO: 258074 - DNA, 398 bp, Homo sapiens
gagtttcttactttaccattttggaagtattttttcatatcatctttcagggactagacctgtgggaggctctgctacctttgctttgaatatgtcacagaccggaaatgagaaagatcttggaggagaaaacacaagtgatttctagtggctaagtctgacagtgatatggtttattgctattcacattctgttagccaaaacccaaccatctggccatttccaactgacagaaaaacagaagtggagtttagctgtgtgtgaatgatggagttagtattttcttatgtggatgggggtctccctaataccacctttacacactagctgagaaaaataatatgattatctcaatagatacaatgaaagtatttgataaaattcaacagccattgatt

SEQ ID NO: 258075 - DNA, 410 bp, Homo sapiens
taaatgagttaatacatgtgaagcacttagcccagtgcctggcagatagaaactctatataaggttaaaggtaataatggtggtagtagtagcagtagttatatgaggatttaaatttcttctttcatgccaggcatggtggctcacgcctattatcccagcactttgggatgccaaagcaggcagatcacttgaggctgggagttcagcaccaacctgcccaacctggagaaaacccgtctctactaaaaatacaaaaattagccgggtatggtggtgtatgcctgtaatcccagctactcaggaggctgagacacaagaatagctcgaacctaggaggcagaggttgtagagagccaagatgatgccactgcactccagcctgggcaacagaatgagactgtatttaa

SEQ ID NO: 258076 - DNA, 383 bp, Homo sapiens
atccacccacctcagcctcccagagtgctgggattacaggcatgagccactgtgcccagcctattcttaaagaataattacaaaatgaagattccgaaaccaccacgtaggccaagctatagaatgcctccgagcctgcagttcacattccccgtgcatcttttccctgttacaaacccctcctatcccagaagtaactagtctgctgatatttgtcattattttcttgcctttagtatttctgcatgcattcctaaacaatatagcttgattatgcctggttttgaactttaaattaaaagaagcttactacatatatgtattcttttgtattttgcttcttttacttaatgttgtgggttgattcacctatattgtaatta

SEQ ID NO: 258077 - DNA, 440 bp, Homo sapiens
actcggcttcagacacttatgagcagaacttacctgaaacatgccctgatgtcccctcccccatctcagctgctttccccaggcttcgcttctgcccctgtcactggcgggagtccatccaaaccttgagtctggcgttcaagtctggccgcctcacccctcctcttgttggcacatcagccttgggcccctctccctggcccactgggttcctgcccctttgtcctcaagcccctctactccagaaagtcagcctgaattgcacccttctccccaccccacccacgtgaagtagaatcaagagcaataccgggctccccacctaaaagctggggggttggtttcaagtcttctcagtccgattattcccatctgaactccatgaacagggaactacagcttctcctctgacatcctaaacatctttaactattaggggt

SEQ ID NO: 258078 - DNA, 670 bp, Homo sapiens
tccctaacgctcaagtctagcccctcatttcctggcaagcatcaagcttgattgtgtctgtaacctctcagaagtcagacctcagaagtgtgcttttctgggaaatcggggtcagggaggaaagaaggagggaataaagacattgtaatagatttatatatatcattgtaactcatccacacaacaatcctgtaaggtgtggccactgtactcagaaaactgaggctcaaagagattgagtaacttaccaaaacttcacatgtactaaaagtggagcctagatttcaaacacctgtaagactctgaaatctatattagctcttctatacatgagcctaaaatgcaactgtaaaccaataagactgacttcctcttgaggcttatcactagctctgaatagaagcattcccaaatgctgtctaagcaattgttgcgtcatgggaataagttgataaattctcagggttacatactcctttagatgcactggaacttttctcagtatgtagaatcaagtgtaaggaaaaaggatttgaaggggaaggggagaaataaaacaggactgagccttacacgtgttgaccagaacagataatgtttggattttctttacttttttcccagagaaatcgaataaagaagtttgtttctgttacctaaaatcaactcc

SEQ ID NO: 258079 - DNA, 399 bp, Homo sapiens
tatcactgtccattaagtagctctttattttagagtatgcataagaaatgacatggaagaaactttcttcaaactacagaataagttaacacagtctaggtttgaaaataaacggtgtagagggttaaagtcttaattatataagattttcacatgatacataaacagctgttagatattaatctagaggaactcaggaagcaagaaatcattggggatcaaataaagagcaaaattttcaacaaacaaagtgtcagaagagcctggtatgaaattgaagcaaaaagctggcatctgccaaggtaagaatcttgattaaagttgctcaaattataaagttgttacagtctggaaaatcagctcccagaagcatctgctgaagctgtttaacaggtgggc

SEQ ID NO: 258080 - DNA, 265 bp, Homo sapiens
cctcattcgggtgatgacaaaggcgggacatgcaagttctctaatggacggtaacagaagaaagcagaggtctgagaactgacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgag

SEQ ID NO: 258081 - DNA, 413 bp, Homo sapiens
ccctgaagaaagaggccgggtgccctcccaatacctggaggaaaggaatgtccttatctttgaagataaaatgacactgagaataatctgtacaaacaagatgaaactgcctttgcaaaattatgacaataagagaaatctgacatacttgactccatcttgtttctgacctccaagatgtccttggtcattcctgggcataggccaacttaactttgggagaaatttattttttttattttttatttttttgtgatggagtttcactcttgtcacgcaggctggagtgcaatggtggtcttggttcactgcaacctccacctcccgtgttcaagcaattctcctgcctcagcctcctgagtagctgggattacaggtgcctgccaccacgccaggctaatttttattttttt

SEQ ID NO: 258082 - DNA, 287 bp, Homo sapiens
aagtgctgggattacaggcgtgagccactgcgtccagccaaaaagctatttttgaatgtgatctgtgtgaaaataattccctatggtatgacatatgataggcagggatgatgtatctcagaaatcatactcctgtcttgatatcccatcaaatatcaatgtttacatttagcgtttggatgtctggcaggacattaaaaaattggcagagctgtcccacacatgcagaacatctatagcgttcttgcctcctcaaaggtaatcttcatgtgacaacaacaacaaca

SEQ ID NO: 258083 - DNA, 432 bp, Homo sapiens
ataatgataattattacatatagacataattacttcaatatgactctttttctcataaaaataatgacatatttgagtcaggcataatacattttttctgaggttggagttagcaggaaaatgttatcttttatgaataaataattcccagattggttgctacatatcatgattcaaaaagtaaaataattacctggatgtggtgatgtgcacctgtggtcccagctactcgggaggctgagacgagagggtcatttgagcccaggaagttgaggcttcagtgagctataatggccccacttgcagtccagcctaggcaatagagtgagaatctgtctctattaaaaaaaaaataaaatgttcttactagaaaacattatatttagaattttagtgattattccatttataatattatccgtagctaccaaa

SEQ ID NO: 258084 - DNA, 392 bp, Homo sapiens
gagagtgtttgtaacttagttatatattactctcaaatgtacttacttggtgtaggttcacaagaattttaaagcaaaattaaaagagcatcaaacggccgggcgcgttggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggctcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaa

SEQ ID NO: 258085 - DNA, 548 bp, Homo sapiens
cagaatgttatggtccagtgaaagtctagagaagaggcacgtcagcagcctgtacacacccagtcacacctgtaacaggaacaggccctaccaactgtgaagccatctcattaacttagacaactgtaccagcaatgtgcacacacatcaggccttttagtaaactgtcaaccccatgattgaagaaaaagcaaaaactttttgaatctagagtctcaggaagaagaacctctagtgcctgaaccagcctgtaatgatggatgcaactgacagtattaacttgacttgggcatacctggagactgaccatgtataaaaaaatgcttctgaatgttcagttttaagctaaaaagtctagtaggggccaatctggtgattattttttatttatgaggaacatcttagccctggtctgtcccatcctgtggcgtggaacacaggccacacaggggattgaggccattccttttttgttaaatgaagtctgacaggtgaaaggttgttcagaaaaaaagtgctaaataaaaatgctatacaaactgcataat

SEQ ID NO: 258086 - DNA, 442 bp, Homo sapiens
gttttggaaatcccaaaattcccttctttttcccagccacagatatgacctcatgagaaaagctgaggtcttagagtcaaatctgagacccagaatagtttgcaagctgtgtgacctagggctagtggctgaacctctctgggcttcctgctccttgatacttacaaggaaatgacaccaccctttccctcccaggtaatttggaaggatttcaatgcaggaaaagtgcctgccttataaaagacttaaaaaaaaaaaaaaaagtgtgctttgacttcttccctgtgcctgcatgggatgggaaggagaacttctcccagaggactggcatggtttgggagcatttctgtttcctattggccccagcggatgggagtcaaaggctgtgagacacagaaccgtggcctgggagcaggaatcaggaagccgttaacgaggaatc

SEQ ID NO: 258087 - DNA, 356 bp, Homo sapiens
  misc_feature (4)..(4): n is a, c, g, or t
  misc_feature (6)..(7): n is a, c, g, or t
  misc_feature (10)..(10): n is a, c, g, or t
  misc_feature (15)..(15): n is a, c, g, or t
  misc_feature (19)..(19): n is a, c, g, or t
  misc_feature (21)..(25): n is a, c, g, or t
  misc_feature (31)..(31): n is a, c, g, or t
  misc_feature (34)..(34): n is a, c, g, or t
  misc_feature (36)..(36): n is a, c, g, or t
  misc_feature (51)..(51): n is a, c, g, or t
  misc_feature (63)..(63): n is a, c, g, or t
  misc_feature (84)..(84): n is a, c, g, or t
  misc_feature (86)..(86): n is a, c, g, or t
  misc_feature (105)..(105): n is a, c, g, or t
  misc_feature (121)..(121): n is a, c, g, or t
  misc_feature (157)..(157): n is a, c, g, or t
  misc_feature (307)..(308): n is a, c, g, or t
  misc_feature (322)..(322): n is a, c, g, or t
  misc_feature (333)..(333): n is a, c, g, or t
  misc_feature (354)..(354): n is a, c, g, or t
gtgncnnctnctctntgangnnnnngtgaantcntncatgggaggagcaangtgggggagganggggtgggggtggggcagaanangaggctgagcagttaatanaggcgctcgaccttanaggaggagagtccgaggtctttattggtagtattcnaatgtggttcatccagagttattttctgtggctgaatggcctactctgaaatccacagggaaaaaacaactcacattcaacccttgagatgctaagttttcttttaaagtaaaggaaatgttataagatttctgaaaccaccaacctttnncgatattgtcagancttctccaacntttccactgcatttgtcagcnat

SEQ ID NO: 258088 - DNA, 226 bp, Homo sapiens
gaaagaaaggagccacatggagctctggaggctgagtggccggcaggctcagtggttgagaggaagctcaccagacagctgtctgctgctgctccatgcttctgcctcagcagcatcacacattacagcagctcatgagccctagacattacctgcatattgttctaaccaggaatatgagttatgtgaaagccaggaatccattatatcattttgttctatttgc

SEQ ID NO: 258089 - DNA, 299 bp, Homo sapiens
atatacatatatagcaaaaaagctggtttaaaaatatcagatggctttgggacatcaactcagtgacaccaaagcatttagaaatgtataataatttgttgcaagtaaaggctgatttcctcgactgttgaagaggtggttttctacaggactgaaactcaggtttcctgagtttcctgaactgtgttgggcagctgttgcccaacgcaattcctgttaagctacacctgctctgtgggccttagatgcctaatttgcttcagggccgaaataataaaagctagaagtggcatgtggta

SEQ ID NO: 258090 - DNA, 453 bp, Homo sapiens
atttctttggggaattgcccccataaacttgtcaatgatttcaccattcttccacccaagctttaccttaaatttgatgcttgtttttgcttcaatattggcagaattcacgttgctctgataggagctcttttcacactgttttgtctttcatccttcttagtgcctcaaattagatactgtgtacaatgtcattacaagttagtaggagtttattttgatgcaaaaatttaaaaattatgcataatttttttgtaatatgcatttttcatgaacttgttgaagacccctggtatagtactgataagtaattttatgtatgactcccttcccctagaaagagccaaatacggctggggtcatgtagactcactagttaagaggcaggactccctggatctgtctgtcattttcccttgggctcaataaaacaggaaattctacagcaaagaa

SEQ ID NO: 258091 - DNA, 354 bp, Homo sapiens
tgaggaatgctgggacaacttttcaaatgtcaattttaaatatatacagaattataccaccagcaataagattttcagtaaatttcccactagtctgttttctgagtccacagacatatatagttcatgaaacaaaattggagccataccacacaaagagttccatatctttttttcttttcatttaacataaagtcattggcatttttcaatgttaccaaatattctgctacagcaattcataatggctgcatttatcagaatagatgtgttataatttcggtggccatgccctgattgttggactttcaagatgtttacgaaaatattactattaaaataacagtgccacga

SEQ ID NO: 258092 - DNA, 192 bp, Homo sapiens
gtatcccatgcacctccccagatttcatctttactcctatctgacatcattgctgttgacactctatgcaccaggatgaaatccaaagatgatatttgagagccccccgacctaagacatgaattattggcttggctgggaatcgaattcaaggtgaattcaatgtgccctgtgcacaggactgctagcatc

SEQ ID NO: 258093 - DNA, 284 bp, Homo sapiens
ctattctctttctctctagcattctggtgtaatttgaagatagtcatgtgatttgaagttttcatgtgtgatgctgggcccctgtcaattctaggagctcccatcctttagttctgggaaaatttcttgaatgattttgttactgatttttttcccctcccatatgctgtgttctctattttggaactcctattcagtcattcaacaaatgttgagtgagattctactatttaacatgcactattctaggcactgggatatttcagtgaataaattagtttaga

SEQ ID NO: 258094 - DNA, 530 bp, Homo sapiens
aaggttcccggtgcgtttggaaggcagaggctcctgggcttgcaggtttgggaaaattatccagaacttggaaaggggtaaaaacatcactgcctgctctttggatcctggaccctcggcacggtgggcctcagagctgatcattccctggggtggggccgtcctgggcactgctgggtgctgagcagtgtccctggcctccgcccactccacaccaggagctcccctagtcgtgacaaccacagaagccccagacgttgccccgtgtccccgaggggccgaatcacccagaggatcagttgtattccagagcctcgaccagcccggccacccgggggtcactttgtggacgcttccctccactcttgccagtgtcctggctctggggttggacgctgcttgggattgacaaatgcggatgagttttgtccctgagcggcaggtgcctccttcctcctgctgcgtataaaactcagtccagtcctgccgttccttagtaaacactcggacgcacctttgacctacagtgg

SEQ ID NO: 258095 - DNA, 528 bp, Homo sapiens
  misc_feature (488)..(488): n is a, c, g, or t
atgagtggctggagccttgcccatcatggagaagccgacctcagggaccccagatttctgaagggaggccgagggctctgtcactcttgtaggtgtgacacggcaaaagtcccagagcatgactgtccctgggaccaggtggactgaggactgatagagcagacatgaccaccaaccaggccacacttgggcctgcgttgcaccttgattgtaatttgcaaggggctgccgaggaagagatgctgaagcacctgcaggaactaggttatttccatagtggtcccgagaccaggtcctgctctcaccaccgcggggaggaagtgagatcttcctgccttgggaggccacccctggatggagctgctgcagcaggcccagcagagaatccgagaactggaggacaaactggagtttcagaagcggcacctgaaagaactggaggaaaagtttttgttcctttttttgtttttctcactagcattcattcngtggccttgatgacttcagtgagccaagaactcgggatag

SEQ ID NO: 258096 - DNA, 394 bp, Homo sapiens
aacagcttcctaagattaagttatcaaatcaacacactttaggaaaaataaaaatcaccattgttgatgagggtaccctaatgggattccaggttctctgctgtggcagcctgtctagagggacatttctgatctgatcaaactccttgaactagtcatcccactggagaaacaaatcccacaggcatcatcagagacgtgcacagacagttaagtacaagggcattttacactgaaatgcattggtacaaagaaatattatgccaccactaaaaatgtttttgaataagagttacagcaagaaaaatgtctgtggtgggctaaaagaaaagcagaatgcaattatattgtgtacacacacacataaaaccaaaataaaatacaccaaaatatt

SEQ ID NO: 258097 - DNA, 394 bp, Homo sapiens
gtcctggagggaaatgtgggaccagggttagtggtacctggtaatcactggtttattccagaactccaggatgaatgggggatgccctactcactactctgatccaaggtataaggggatcaggaaggaatgctttcagctgggcgtggtggctcatgcttataattccagcactttatgaggccaaggcgggtggatcacctgagttcaggacaaaaccccgtctctactaaaaatacaaaaattagctgggcttggtggtatgcatctgtagtcccagctcctcggaaggctgaggcacaagcatcacttgaacccaggaagtagaggttgcaatgagctgagattgcaccactgcactccagctgagcaacagagagagactctgtctcaa

SEQ ID NO: 258098 - DNA, 278 bp, Homo sapiens
taaaacataccgtgtttcagatgtatttagaaaaggcaatatgagcaaatgggaggatatattaaaggcaggaaaaagacaggaaaaaaatattactatggggggctcttttcccagtgaccaccaagcttctgttaggcacattgaatccttgtggatatacttgtaataatggatagaaaattaaattgaaatctaaacccaaataaagttctcttaatttgattttgtcctctggcataccataagacatgaataattaaataatgttacaaatt

SEQ ID NO: 258099 - DNA, 686 bp, Homo sapiens
acattacatctggctctgctgcttactaaatgtgtgaccttaggcaagaatttaatatttctatgcctcagtttccatatctctaaaattggagaggcagtatacactgtattggtccattctcgcattgctataaagaaacacttgagactgggtaatttataaagaaaagaggtttaattggctcatggctctgcaggctttacagaaagcataattctggcatctgctctgcttctggggaggcacaaggggagcaggcttttttcatggcaggagcaggagcaaaacagagcaaagagggaggcgcaacacacttttaaacaaccagattttgtgagaactcactcaccatcaggagaacagcaccaaggggatggcgctaaaccattcatgagaaacccgcccccatgagccaatctcctcccatcgggccccaccaccaacactggggagtacagctgaaaatgagatttggtggagacacagatccaaagcatattccacacagtaaaagttgttatgggagatcaaacaacttttgacacacagagagacacaatcacacaggtgcacattcacaaacatatactaagtgtttataatagataaatttatatatttgataattgctggcgtttaaggatcatgattgaattctaagttgcggtcaggtcttctaggct

SEQ ID NO: 258100 - DNA, 334 bp, Homo sapiens
cacggccatactggatggacctcagcatgaccaggacacatttcagctcaaatcccctgtgccaagaacacattctgccaaggaccaccacctcttcccacaactgtgagtggatttatgtcatcacaggaggtgcaaaaacgtgtggtgaggtaaatgaattgggatgtccttggctgcctgagcaagagggcaactttcctgcctttagaatagagaaaacacagcaggataattaagaggatgagactttggttccaacagacagtggcttctccttccctaaattgcccttattttgtagtaagttataatatgtttattttctaccacc

SEQ ID NO: 258101 - DNA, 207 bp, Homo sapiens
accagtggtattttaaagattatttttttcattgagatgttcttttcttctgtcatgaaaacagtgaacatgtagaaaagtattttttaattagctatacaaatttcttctacgcaggcccactcaaaacagatcaagacttcaccgtgctttatatttgaaagatattaacattgttgtccctggacttttctatcatagcaccta

SEQ ID NO: 258102 - DNA, 597 bp, Homo sapiens
tctgcaaagacactatttccatataaggtcacattcacagctactggggttaggacttcaacctagagggcctgacttctggcccaacacatcatggcccatcccagcatgccccatccccttcctgggtgccccaggcagatcacaggagggcctgactgctgggctttgggctgacattgggatcatctgcctagttagggctgtgaccagactgagataggaggtgggacctgactcctgaggcagggcttgaactctggaccagattacagactagctgaaacaggcaaaagcacccctccataagacacacccactggtgccaagtgagtttgccgttctcatggtaacagctggaaattactgcccctttccatggcaatgacctgaaagttaccaccccttttctagaaatttctaaataacctcctccttaatttgtatatagttacaagtgggtataaatatgtgtgcagaactgcctctgagctgctactctgggctcactgcctatggggcatccctgctccataaggagcagtacctctgctgccactgtgcacagctgcttaaataaaagttgctctctaatac

SEQ ID NO: 258103 - DNA, 121 bp, Homo sapiens
tcgttggctgttgtttaatgggacattcaaaagctttaattgaattcaaaaaggagttatttaagatttggacttaaaatcagcccattcctttattgtgtctctgtacaaactccgtctc

SEQ ID NO: 258104 - DNA, 389 bp, Homo sapiens
ggacattgtagcattgggtccctaagaatgatgttttaaatggttaaaaagttcccagaagacaagtgtgaaatgctgctcacagagtagttttattttttcagcaccttagtaccttctttatttctcttccatagtatgcatgattagagttggcccctactaacaccattcctttgcatgtgtttctaaaaaagtatttcagaaatttctactgaaagtttggggattgatagaatttaggattgcttatttgtatttgcttgatataattcacatattgttgctgtagatgaaagttctataaaagagcatcatgcctattttgcattagctctagaaacattgctgctgtttgaattcactatcttcctccctcctcaatgaga

SEQ ID NO: 258105 - DNA, 305 bp, Homo sapiens
cggaaggcagtacttacaggatgggggtaatgtctacttcacaggcttgctgtgagggccaatgaaatactatacaaaaattatttagcactgtctgtggcacatatagtaatgattcccgaattgggagctcaaggaatagacccaagttttgtgggcctgcagattcagacttttcttatgaaaaaaaattgaatgttataaaatgtttacaaaagtgattatctattgagattaagaaatcacaacaaatcacaaaattttacaagccgcaataccaaaacatcctaaaatcagaatccagg

SEQ ID NO: 258106 - DNA, 439 bp, Homo sapiens
ggagcccttagctctgagcaggacctgaagccatctcagggcttgcaccggtccagatgctgctgcacaagtgctccaggggctcctgccctgccctcctcacttgccccctcacctgtcagggatgtttgattcctggctggcccctcccctacctgacccctgccaaagacctacgccaccccaggctcccagctctgaagcaaacaaccagagaagtcaagcgcctggctccgggccacacagcttgagggactcagagctccagggacagtgcccgggccctgctcaggccttctgcagaggctctgggctcttccagttgactcagctcacagggcccctacacagtaccaggtgaagacacagccccaagaaccctcagggtctgaagccacacatgtgagccgtgggcagaatcctgcattggcctccagca

SEQ ID NO: 258107 - DNA, 630 bp, Homo sapiens
cttaacaatgcctgatctgcctagatttttgtggtcagctcacttagtcttcacggtgcctgtttctgaccttcactctcttcagtcccttctcttcagtcttagcaaaatacttaacctcctgatacttagagaaaacagaagtcatcattagaaattcattcaaattcttcctgccaaacttgtaaacttaattgcatcagtacctggtcgtttcctcaactacttttacttaaatggaagaaatgtcaggctgggcacagtggctcaggcctgtaatcccagcattttggaaggctgagccaggtgaatcacctgattttgtgagtttgagaccagcctggccaacgtggagaaaccctgactctactaaaaatacaaaaaattagccaggcatggtagtgcatgcctgtaatcccagctacttgggaggctgaggcaagaaaatgtcgtgaacccgggaggcagagcttgcagtgagcagagatcgcgccactgcactccagcctgggcagcagggcaagactgtctcaaacccttaatggacaaatcccttggttttggtcacacaaggttttttttgccattccttttgtggaggtccttcttgggcctcagttaggttttggt

SEQ ID NO: 258108 - DNA, 427 bp, Homo sapiens
aaatatttcagtatccatgtgtaaaagataagggttcccttcttaaaagtataatcatgataccatcatgacacctaaaaatattaacaataatatcttaatatgacaaacttggaaaatacatttagatatataaatggcaataaataatacagatttaagtaccactttcactgatattaaaagataaacctaggcacattaaaattttaaagagtttatttgagcattcagtgattcatgaattaggcagcaccagactgcaagtgatttgggctccaccaaaggcgtgcaagggaaaacttttataaggtgtctgtggaagcaggacagagaaaatgtttgatttattaaagtggagagtccctacttagaggtaattggcagtgtctggtaaagactctagatagagattcactggtgcttt

SEQ ID NO: 258109 - DNA, 311 bp, Homo sapiens
  misc_feature (37)..(37): n is a, c, g, or t
  misc_feature (167)..(167): n is a, c, g, or t
  misc_feature (306)..(306): n is a, c, g, or t
  misc_feature (311)..(311): n is a, c, g, or t
gcagaggggagaagcggagagactgcagggtacactnggagcctcccaggaggcctctcctatcccagaagatcccaggggtgtcataggcaggctctaaagtcccagggtttggagcatgtggtcggtgtctctcacggaaggcccccacatgcaaaaacgggacntcaaggtggcatgggtcagccgaagggactcaaggaatcattgaggcaggcagaggggagaagcagcgggactgcaggggatgctggtagcctcccaaggacgactctcccataacagaagtcccaggggtgttctggncaggn

SEQ ID NO: 258110 - DNA, 208 bp, Homo sapiens
tgtgccacaggcctagggaggacaggcatttctgttttcttgcccaaatgctgcatttcccaagaccatcctggcctgccacacccccattctgtgcctataaaaacccccaagaccctagcgggcagaaacacaagttgctggacatcgagaggaacacacaagcagaggaacacacaagcggcgggatgtcgagaaggacccactg

SEQ ID NO: 258111 - DNA, 372 bp, Homo sapiens
attatatatatatatatataaaatatataatcttaaaatatatatatatatggccgggcacggtggctcacgcctgtaatcccaatgtgctaggattacaggcatgagccactgcacccggactaatttttttttttttaagtagagacagggttgcgctgtgttgcctgtgctggtctcaacctcttgggctcaaacaatcctcccacctcagcctccctaagtgctgggattacaggtgtgagccactatgcctggcctccagcgctcattctatggaagatgtcacccaaaccagtgaaaccagtggctcctaaagatggtgatcctttgaggaatttctgtaaaaatatagatttctaagccctgtca

SEQ ID NO: 258112 - DNA, 215 bp, Homo sapiens
tctcccaccccttccctctgctaggctgttctgggcacccactggcatagcatggaactctcctgaaggtgacgccttggtgacagtgtctatactgtggcttcagccactttgcccaggcaaaaccaatatccctgatgcccccaccccattacccttccttccagcccactctcacactcacaatcaacctgcctcctgtgcttgccctaccc

SEQ ID NO: 258113 - DNA, 1153 bp, Homo sapiens
gctacaatggtaagcaagacagaggagacggctgctctgatgaagtcacagttaaggagaggggtcttgtaaacaggtaagtaagataacgtcaaacagcgataggtactaggaaggaaattaaagaccatgatgtgacagtgtgtgacttaagagggcaacatcaaagacagggaagcctttggtctaagaaaaatcaacatattgatctaaagtcatttaccatgtcacttcagtacaatgaaaagattttttaaaattctactgaatattataacttattataactgaataaaccacaaacagagcagatgcctggagggtcttctcaggaaacttggcaatattaggcagctggctggtagaaactccaaggacccagagaccctaatcctgacctcttcctagtatgactaacacatgccactggtgaaaggtacataatattcataatcttggggacaaatctgaggtttcccagaggcagtttataatgtctattacctaaaaacaaattttttaaagttacatttgaataaagccctgaaacataatatttagaaaacactacatttttcttgatttatttttaagaattggtgactcctcaaataatatggcaagttattactcaaaatccaaacagattatccatagaacatttatgaccatttgcacctgccctaatggatagtttctgctgccttcttggcaccattctacaagtcatctccactatgctctatgaatctaaacctgaataatgctggctaaaataaataggaacttacttttctcactaacagaaatctgaggaagacagctactggagttggtctgaccacttgatgccatcaaggcccagactctgtatctttgcactctcccattcctcctcatggcctcaaagtggcggctacaactccagatacaacttcagcgttcaaggcagatgacagaagtaatagtgccagtcacatctgttcttcagcaaacttctgcttctgggtcagacagccactcctaattgcacagaaaactgggaaatgagtatttagcgaaaagagggttcaggatgtggggtcagccaaacaacagtgtctgtcacacactggttgagccaaatatgggaaaccaatgtccaacttccttc

SEQ ID NO: 258114 - DNA, 409 bp, Homo sapiens
  misc_feature (369)..(370): n is a, c, g, or t
agagtttgtgatcatgtgtttttcctctaacccagacatatacgtaggtctaaaactgcacagtgcaggatgtcaaatggcttaaaaggatttctgctgtgactgaaagagtggatctgtgcccttctgggggtgtaggctgaccacatgaataccaataattagacatttccaaaccctcctcacccatcccccagcatgctacagaagcagcaggctggcagaggtccagatttcctaagtgatgggattgttcccccggccaggaatgagaggaatctgcctagattggagatggctttagctactttgcttttcttcgtactcgtagtctttcttcgggagatcaaggaaggaggactgcttganncaagcctgggcaatataacaagaccccagttctaaaaaa

SEQ ID NO: 258115 - DNA, 518 bp, Homo sapiens
ctatgtcataacattaatgacaaataatgagtcactttctaattttctattcagagaaacgcaactctgcaataattagacatcttttattttaagaaatgggcagctgtttctttagttgaattttgatatctttatagttactttgctttctttaaagggcttttctctgtatatatgcatctctttggcagggttgatggcagactgggatactggcatggcaatagtgggaaagaaggaaggaaaaaaagcacaactgaaaaggaaaacctgaagtgttctgaatattagattttaaggtattagttgtttttttaagttttctttttcaatttattaaaaagtagaatatgtaagtattgtgaatatcaggttttttttcagtgattttaaggtaaatgttagtaaaaagaataaatatgtattttgagatattaaaattgtattgcaccacctgacacaatctgttttacttatgttattaatctgttgtgttgtaggtagaaatatagcat

SEQ ID NO: 258116 - DNA, 354 bp, Homo sapiens
tagttcatttattttagatataattaccaaatcagtgttctacttttttcttcaaataacaaaatgctggccgggcatggtggctcatgcctgtaagcccagcagtttgggaggccaaggcgggtggatcaccaggtcaagagttcaagactagcctggtcaaggtggtgaaaccccgtctctacttttagttttaatacaaaaattagccgggcatggtggcagacacctgtaatcccagctactcgggaggctgaggcagagaattgcttcaactcaggaggcgaaggttgcagtgagctgagattgcaacagtgctctccagcctgggcaacagagtgagactccatctca

SEQ ID NO: 258117 - DNA, 423 bp, Homo sapiens
  misc_feature (158)..(158): n is a, c, g, or t
  misc_feature (220)..(220): n is a, c, g, or t
  misc_feature (249)..(249): n is a, c, g, or t
  misc_feature (315)..(315): n is a, c, g, or t
  misc_feature (318)..(318): n is a, c, g, or t
  misc_feature (402)..(402): n is a, c, g, or t
  misc_feature (404)..(405): n is a, c, g, or t
  misc_feature (407)..(407): n is a, c, g, or t
  misc_feature (410)..(411): n is a, c, g, or t
  misc_feature (414)..(416): n is a, c, g, or t
  misc_feature (418)..(419): n is a, c, g, or t
  misc_feature (422)..(422): n is a, c, g, or t
cattatgctgagtgatatctttttttttgagactcagtctcaaaaaaaaaaaaaaaagaagcctcaggacacattggtaaaatttctcacataagtatgacacacctgggccgggcgcggtggctcacgtctgtaatcccagcactttgggaggccgnggcgggtggatcacgaggtcaggagaccgagaccatcctggctaacacggtgaaaccccatntctactaaaaatacaaaaaaaaattagcngggcgtggtggcgggcgcctgtagtcccagctacacgtaaggctgaggcaggagaatggcgtgaanccnggaggccgagcttgcagtgagccgagatcgtgctactgcactccagcctgggcaacagagctagactccatctcaaaaaaaganannantcnncannngnngcng

SEQ ID NO: 258118 - DNA, 541 bp, Homo sapiens
aacataggagccaggactctggccttgcattagtgtgcttttcatattaatgctcaatctttagaaaaacttgaaataattctcgtataattttagccaacttgctcacacacaaaattcttttcgcaagattcatctttcacaaacctacaacttacttaaacctccagttttgtcttatactttctctttttgcattgggattctataaaaatgtgattttctctcttctttattgttttgaccacaaagtcctcagtcatgtaaaagaaaaaaatcactttctcttttcaactttctttgcatcttacttcctttatatgctctataatagaggtttttcctatagcaagtagttttaattatacatattagctataacattgactcttagtgctgcaggtagttagacaggcatgagtggggcaggaaagggctccccacccactaggaacattaggtgctggtttggcaattatcacattgtctctctaaaagtgataaataaaataaataaaacaaaagtgataaaaaagcacca

SEQ ID NO: 258119 - DNA, 783 bp, Homo sapiens
ttttttttgagacagaatcttgctttgtcacccagactggagtgcagtgggaacaatctcggctcactgcaacctctgcctcctaggttcaaacgattctcctgcctcagcctcctgagtagctgggattacaggcgcctgccaccaagcccagctaatttctttttttagtagagacagggtttcaccatgttggccaggctggttggaactccaatggcccctggttcaagaccagactggtctcgaactcctgatctcaagtaatccacccgcctccacctcctaaactgctgggattaaaggcgtgagccaccacacccagtaatgtcctaattttaatattattctggagttacatagaagaatatccttattcttaggaaatacacacttggggtgattgtttacaatttactctcaaatagttaaaaatttatttatttacaaataatttttatatttatatatacataaagagacaaagtgaatgatttttaaaatggagttaggttgagtgcgctggctcatgcctgcagtcctagtactttaggaggccaaagtgagtggatcgcttgagcccaggagttcaagagcagcctgggcaacatggagtaacctcatctctacaaaaaatacaaaaattagccggcatggtggtgtgtacctgtggtctcagctacttgggagggccgcctgaactcgggaggttgtggctacagcgagccatgattgcatcactgcactcaagcctgggtctaaaaaggaaactaaatattaaaa

SEQ ID NO: 258120 - DNA, 520 bp, Homo sapiens
aaggcaataattttgcatattttgcatctttcttagaactttcagtgcatccaggttttattgcattgatcctaaagagaggaaagaagtatgcagggtctccatttttcagacaagagccatttcttaaaaaaaagactactcctgagcttcaagtcagtgacaaaaaaaaagactgcttattgtgacaatagactttagtcatattaaagcaattcaaagtaatttaaaatgtggggaggccaggtgcggttgctcaagcctataatcccagcactttgggaggccgaggtgggtggatcacctgaggtcgggagttcaagaccagcctgaccaacatggcaaaaccctgtctctactaaaaataaaaattagccaggtgtggtggcgcatgcctgtaatcccagccattcaggaggctgaggcaggagaatctcttgaacccaggaggcagaggttgctgtgagcggagatcatgccattgtactccagcctgggcgacagagccagactctgtctc

SEQ ID NO: 258121 - DNA, 329 bp, Homo sapiens
atatagtgagagaacccaaagtctttgctaatatcttaaatcctccaataatatcgctggtgacacgtgggaactcagtcaactacaaagttaaagagaacagtttacacaagactgccctcacttctgataccaattgtgagtttggggagggtcccccaaactacccttaggtttgataatttgctacgaggcctcccagaactcactgaaaattgttacactgatgattagggtttattacagggaaaggataataggttaaaatcagccaagggtctttttgactctctgagcagcaccatgacatttggcaagaacaagcacct

SEQ ID NO: 258122 - DNA, 264 bp, Homo sapiens
tttgggttgaaagttactgagtagtcactatacaaatattgtgctgtatgttctacatcaattatttccaattatttcatttaacctccacaacaagatataaataagcactacactactgtgctcgttttacagagtaaaaaacagtgctgtgcctcaggaaacatttatggctaattgatggaacttggatgtaagcacagactcataatcataaagttaagttactatgaaacaaatttgtagcttatttttcattaaata

SEQ ID NO: 258123 - DNA, 323 bp, Homo sapiens
cagttttcagtctgggaatgtgcactagaattacttgaacagctttataaaaatatttgtgcttggcaggccaagctaagaggattgcttgaggccgagagttcaagataagcctggttgatgtagcaagacctcatctcttaggaaaaaaaaaaaaaaaaaaaaaaaaaaatttagcctggcatggtggcatgtgcctgtagtcccagatacttgagaggctgagactgccggagaccttgagtccaggagtttgcagttacagtgaactatgataatacaactgcacttcatcctagatgacagagtgagaccctatctca

SEQ ID NO: 258124 - DNA, 664 bp, Homo sapiens
ctgatatgcagatgggagcccgtggcaggatgatggcaggataaccgtcagcccaaaagaagcggccacgagacgccgccgagagccccaacttagaagccagagtcaccagcttcctggctagggtctgtccttgagggtcaccagaatgtgaggaaagacccagacaggcaggaaaagagctcagggaaggacatcttaccattggcgtcatcagagataccgcatccacgaatgaagagccagacgctgccagaggggaacgctcagagcaccggaaggagcttttagaaattataaataagcagcacattttaaaaaagccatagaagggctagaaaagaaagttgaggacatctcccagaaaatagaacaaaaagagattaaaaaacaactgggcagtccctgcagaggtcaccctggctggcgcggctcaggatggagggcgggagctgtgtgcctggaggggggagctgaggcacgtcaggatgtgtctccagactgcaagggccacagagtacgaaaaagaccacccagagcaatgtggtcaaagaccatgccttaaaaggttttaggaaacagaatgggtcccacgggagggtggggatgtgaacggcaccagcctggtggctcgggtgccaggccagggccagatgtagcctca

SEQ ID NO: 258125 - DNA, 357 bp, Homo sapiens
aggttggaatgcactccctgaatagcccctgttcatccaaatccagccttcgaaaatctactcctttttcctccatcaagtcttcaaacccatgaagatttgttgtccctaaatatttctcttagagaagcacattataaccaattggctataatgaagtattctggaacgatcaggatttgctgagtattggagaaagatccatccacttagaagaagaattaaacaatcagaagtggacacgacctggaccatcagcccagcactccctcttctgggtgctgctcctctcacatcatccacgtggttccccggcagcagccacatatgcacgatgtgcccacccccagctgaaga

SEQ ID NO: 258126 - DNA, 412 bp, Homo sapiens
gttttttcccttatgtctaatatttttgtaataccacttttataataaacataaatcaacttgaagcagtgtttacaaatgtcatttcttacttgatatgaacaagtttacttttaaaccttatctgagagtcttctataagtgatcttaaatgttctatggagaccacagtattgcttgccttttcacttttaactcaattcctttctcagagcagcatacaattatttaaatataggcacctcatcaaagcacaagttatatgcatttgcctttcaaaattatcttaaaccaggagcagtggttcaggcctataatcctagtgttctcggaggctgaggtgggagaatcacttgagcccaggagttccagaccagcctgggcaacatagggaaaccccagtctctaccga

SEQ ID NO: 258127 - DNA, 3435 bp, Homo sapiens
tcaatgcactgttcaaggatgtttgagagattttctgtcttgcctgaatacaaaacactgtagggaacctcttgtgcttgactttgcacacacacgggatcttcagggtgggtacatttaaaactgacaagtattgccaaattgccccccaacgtagtttttacaccccacctactactctcagtgaaaaatcaggccctttttattttaagggctaaattgctaatccctgtgtgaaaatgggtgttaacaaaataaaaaataaggaaaatatgcaggcttacccaattttgttatctatacattttacagtctctaatacttagcatagctcctttgggtgtctgcccaccacccttctttctgaacgtggggttccctgggctttccttgtttgacttcagacctggatctaatagggatctggaggtagaatcaagacgaatgttccctttggccttaggtgagtcctttgcatctctgaggccctgttgatgacatccagttctctagacctctgcccaaaccagagcaatccctcctcaaatatgctaagcagaaatgcagacaatataagacacactatatttatattttaggagtttacattaccttcccttctgtttggaaaccaacatctctcaaaattaggtatagttaacacagaataccccaaaataccaccattcttcataattccatttccttatttctggattctttcaagggtaaaaaccttgtttcattcatctttggggcagcatttgcctagtatgtggtaggcgcccagtagattttggataaactgacctgattttctgttaatattccaactggattatttctttctcctcttacagaatgaagatattcaaatgttattttaaacataccctacagcagaaagttttcatcctgtttttaaccctatggctgctctctttgttaaagcttctaaatgtgagacgactctttccgcaaaaagacatttacttggttgagtactccctaagtacctcgccttttgtaagaaacagatacactcatgttaaggatgaagtcaggtatgaagttaactgttcgggtatctatgaacaggagcctttggaaattggaaagagtctggaaataagaagaagggacatcattgacttggaggatgatgatgttgtggcaatgaccagtgattgtgacatttatcagactctaagaggttatgctcaaaagcttgtctcaaaggaggagaaaagcttcccaatagcctattctttggttgtccacaaagatgcaattatggttgaaaggcttatccatgctatatacaaccagcacaatatttactgcatccattatgatcgtaaggcacctgataccttcaaagttgccatgaacaatttagctaagtgcttctccaatattttcattgcttccaaattagaggctgtggaatatgcccacatttccagactccaggctgatttaaattgcttgtcggaccttctgaagtcttcaatccagtggaaatatgttatcaacttgtgtgggcaagattttcccctgaagtcaaattttgaattggtgtcagagttgaaaaaactcaatggagcaaatatgttggagacggtgaaacccccaaacagtaaattggaaagattcacttaccatcatgaacttagacgggtgccttatgaatatgtgaagctaccaataaggacaaacatctccaaggaagcacccccccataacattcagatatttgttggcagtgcttattttgttttaagtcaagcatttgttaaatatattttcaacaactccatcgttcaagacttttttgcctggtctaaagacacatactctcctgatgagcacttttgggctaccttgattcgggttccaggaatacctggggagatttccagatcagcccaggatgtgtctgatctgcagagtaagactcgccttgtcaagtggaattactatgaaggctttttctatcccagttgtactggatctcaccttcgaagcgtgtgtatttatggagctgcagaattaaggtggcttatcaaagatggacattggtttgctaataaatttgattctaaggtggaccctatcttgattaaatgcttggcagaaaagcttgaagaacagcagagagactggatcactttgccctcagaaaagttatttatggatagaaatctcactaccacatcatgatagtaaaatcaggatggaaataagagggtgcctgataaatggagtcagtgtggaattgaataccatactatgcccaatactgtttaaactcagtcctcccatattttaaaaggtgtccaaaattccatacacaagggaaagtgatctagcctttgatgttattagcctgcagttggctaggtttttttaatatttgtttttgcttgtaatctcactgagccaaatcagagatcttaaacattcagtcagtcatcaaacattattgagcacctaactatatgacaggcacttttttagagactgcggcttatcctcatcatagcaacctcggtatctttaagttctccacataacagtcaggattctactgaagaagcttttgaagtttgtggtaatcgtctgatcatataaaccacccatttcagagtagtgtttaagtactgtgaccaacactccacttgtctcttaactcagctttcaagacattccttaaccatcagagcagaggaggaaagactcactacctcagaaaaatctcaaagaatagtccaatttcctgcttgccaaagcataatctgccttttggtgcattacttggtcaattcagggttgaggagactgttggggggcatttataatgtatgaaagttaaggaagggggtgaggatgtgggttgggacaggtagtacctaaagaggagcgaagggatttatacaacatttttatcatgttacaaaacagtatcatgaatggcctcctttttagttcaactgtttctttaaaatgcatttactgattaaaaataagaactgaccaatagctccaagtgtcacacaccagaacattaagcctaagtcctcaattcataagttatcattctagacaagtttctttacaatggaatactttctatggaatcattataattctgttgtgtggaactatcaagctaagagtcactaaactttcttgaaaaggttgtgtgaaatatgacagctttctaaattaatttgtatagtcatttaaaattttttcttctctggcaactgtccaactggaatccagatttaaggtgataaaagctctaagtttcttgcagtctttttctcagcttagttccagagagaaaaaagctaattttcctaaggacacagcaagaatattcattaaggatattttctaaaacccacacttgagaaaaccacccaatga

SEQ ID NO: 258128 - DNA, 481 bp, Homo sapiens
catgagaggggagcagtgggaggctatatgttgatggaatgaggggctcctgtaatactttcctgttaacattaaatagttacttctcttaattcctggaataagctagaactccttaaaaattatgaatgttgatattactgaaaaataatgacactctcaaaagagagtagtaataagtaaatcttatctccagatttcacaactctattacttcccttttccatcctatcagggtttaagattttcagcaataatgcatctaaaatactgaatatatgtaaaataccacgatagttatgtctgaaatgatacaatgtctgagatgttcttcaaaagtacacagggtggggagtgtatgggggtgaggatggggcaggattagccatgggctaatggcttgttgggatggggtgatgggtatatggaaattcattatattttattttatggtcaaatttctccacaataaatagttttc

SEQ ID NO: 258129 - DNA, 302 bp, Homo sapiens
ttaaaaattaaaaagacaatgtgacaagctaattgacagacaaagattagtataagaagtcagaattggtaggtagttccacccccaccaataaaactctccctttagaagaaatacagttattcactgcatagtggcattttggtcaacgatggaccacatatattatggtagtcccagaagattataatggagcatatatagaaacctgatatacagcacttgatattggcattgcagatcagttgcggtaatgattgatgttcattattggtactggaacattttgttttccatatgag

SEQ ID NO: 258130 - DNA, 699 bp, Homo sapiens
caaaaaaggaaaattaccattgatccaggttgccatttttaataaaaagcagtaaggtcttaaagaaaatattagcattgaagttcaaccaaataaattactttgtcatcaaaatgaagaatgccagaaagttctctgaaatacaatttttaacaaaactgagaaagcagaggaagtattttttaatattacaaatttttgacaccaacataagaattccatgatatcctaaagagcaatgaacccaggtaatgcagtttctagaaattttaaaacactaccaaataatattgcttcttgcattaagtatagcattggtttgctagaataatcctaacaatgacaatgcaatgtactttaaattggggtcaaaaaacttttttcttaaagtaccagatagtcaagcttttaagctctatgggtcatccacagacacactgcaactatacaaactatatcacccctgttgcaactacacgaaaagcaggaaagcaaccacagaagacagacaatacataaacaaatgagtatgactgtgttccaataacattttattaataaaaacaggcaactggcccatgggtggtaatttgctgaaacttggtttaaattattattagtatctacctttttttaaaagatgatgttttttagggtctttccatcatgaaaattatgtttttatgaaagtgatttggg

SEQ ID NO: 258131 - DNA, 990 bp, Homo sapiens
gacgtcatacagtgaagcaacggaggcccagcaacatggacaatctgcccaggatccacatagctaccagaggggccaccgcagggcaaagtggagatcaaaccccagttgagtatggtcctaaatcctgagtcctccacacagtcctctgtgccgggagaacatgaatgatgaggaatggacccttcccacccatcctgatattatcagatcaggcccttctcactactccttccaatgtgaaatgctccttcctctagagctttatgtcatttctctgcatgaaataagtcctggtagctgctgattaaagaaataaacaagcctcaaacagaaggccaaaatcatagacatcttgggtgttgccagttatccatccagagccggatgggtcagctctttttcttccttaggcttgcagactgcttgctgacttgattctgtttttcagcttctctgagatggacagagaatgaatgtggaaggcagtggaaaagctctccccagcttttgtgtacaaataccaggagaaaaggcagcctaccactcccacataaagagctgtaattactagctacagaatagaattcttttgttgtccagcttttaatgagttttgtaaaaaccatgcagaattaaagtgctctactaaatggtttcaggcagacacacaactaatcaaatttaagcttgcttattttactcaacagggcttgttagatggcagacaagccaagtttttccacataaatcaatttcaagtttggtgttgctgatggatcgctgcttttaaaccaaaaaaaaaaaaaaaaaggataaagagcagaaatgtaacagctgagaatggttacatttaaaaacaaggagaatttgcctgacaacagtacccttattggaacaagtaatcacttatgtaagattatttagataaatttgaaaacaaacaaaaaaaagaaacaacacaaccttgtaacacacatttgaaggtag

SEQ ID NO: 258132 - DNA, 296 bp, Homo sapiens
gaagcatcgaagcgcggcagccatgttcagcgtggcatttcggaaggcttgtcaggggtggagaagcggggcgggttgctgttctttcacctgacactaaagcgccatgccggaagcactgagtctgatacgtcggaaccagtctccaccgtgtggtttggtcttgatttccactggtactctggggtcttggataagtctctggacctcgcctttgtcatttgcgaagtcgataggttccaatagagattttcccagaatcattcaactaaaaatagagaactttttttttttga

SEQ ID NO: 258133 - DNA, 408 bp, Homo sapiens
tgtttcacacctataatgccaaaactttaggaggccgaggcgggaggatcacttgagccctagagttcgagacaaacctgccaacatagtgagacccccgtctctacagaaaatacaaaaattagccaggtgtgccaagtggtgatgtgtgcctggtacttcccagctactcaggaagctgaggtgagaggattgcttaggcccgggagattgagacctcagtgagctgagatcgcgccactgcacttcagcttgggcatcaagcaagaccctggctcaaaaaaaaaaaaaaaaaaaaaagggcaggtatattggatttagtgaacaattggatgtgttatgtatttctgcaacaaaatttttacagtaagcaaacagtgcttttgtggaccaaaaatcaaattaagt

SEQ ID NO: 258134 - DNA, 256 bp, Homo sapiens
  misc_feature (13)..(13): n is a, c, g, or t
  misc_feature (27)..(27): n is a, c, g, or t
  misc_feature (215)..(215): n is a, c, g, or t
  misc_feature (222)..(222): n is a, c, g, or t
  misc_feature (232)..(232): n is a, c, g, or t
  misc_feature (255)..(255): n is a, c, g, or t
ttttttttttttngtatttttagtagngacgggatttcaccgtgttagccagggtggtctcgatctcctgacctggtgatccgcccacctcggcctcccaaagtgctgggattagaggcgtaagccaccgtacccagcagctctcttgttctttacagaagtcttgcaaactagtatcatcctcattttttagctgacaatggtgaggctaagangttaagncaactgcccntgaaatgagcaagtgccagtgcnt

SEQ ID NO: 258135 - DNA, 326 bp, Homo sapiens
gcaaaaaagttatactcttttactttttgtacaactttcaaaagatttttgtaaaagataagtgagtcaaaagcatgctgctactgctttcctatcagctactcacctaattagagacaagtactccatttttctaacatatttaactcttcaaacatttatcatttttcagtcagttagtaagtccttcaccaaatgtttaactgagaattgccgtgtaccagatgctatgggagacacagagttgtgtaaaaacttcccggagttgtcctctgtgaactgcaagctagtaagaaaagaagaagttaatgcaactaactccaaaa

SEQ ID NO: 258136 - DNA, 126 bp, Homo sapiens
caacctcctccactgccccctctccctcagcaacctcctccactgccccctctccctcagcaacctcctccactgcccttctctcctttggactctagatttcaggttccctggccttttttcagc

SEQ ID NO: 258137 - DNA, 404 bp, Homo sapiens
gttttaattgattgcctttaatttcagattataaacgtggttgtcttactgtatcctttattttctattcactaatacagatagatcacacgggaagacaatactttaagggcaaaaagtaaaataacttactagaatttctaaactttatgtttacttttacctactaagggatatctgaaaggtagagacatacttttaaaactttttgcttctggcactatgtaaacattaattcatgtaaactaatgactagcagaatgcctaagatagacatgaacagtctgaaaaagtatttactttcagtcatgtcaagtttcggaaagtgttaacattttgaaagtttgtctatatatcatgtcctttcataattattgtgaaattataagacgatgcttctcctt

SEQ ID NO: 258138 - DNA, 414 bp, Homo sapiens
gtctgaacctgaccatgttttttaggaaaatcctgtgattagcaataaagtaacataaaaattaccaaggcttagtctacgaaaacctaaggtacgtggatcttacatttcccagataaatggggggctttttaaaattgatttttaatattatgttttatgctagcagactggacaaagaaatgtggtacacagacaacatgcgatactacacagccataaaaaattaaatcatatcttttgcaggagaatggatgcgaccagaggctattatcctaagcaaattaatgcaagaatagaaaaccaaaaacccatgttctcacttgtaagtaggaagtaaatattgggtactcatggacataaagatagcaacaatagatgctgggaactaatagagttaggaaggagagagga

SEQ ID NO: 258139 - DNA, 420 bp, Homo sapiens
gcagccctataattaaaaatctgagtgggaggcatactttaattggtaccttgaagcttctaagcacactcaggatcctaaaattgcctctctacaagacacgatctcaaaattaattaagataaacagttaagaaaaaacaagggccaggtggctgacgcctgtaaagccagcactttcggaggctgaggtgggagaatcacttgaggccaggagttcaagaccagcctaggtaacatagtgagacctcatctctacaaaaaataaaaaattggccaggcatggtggcacacacctgtagacccagctactcagaggctgagtctggagtattgtttgagcccaagaggtggaggctgcagtgagccatgattgcatcactgcactccagcctaggtgacagaacgagaccctgtctca

SEQ ID NO: 258140 - DNA, 506 bp, Homo sapiens
tctctcttagcttcagtgagtttccaccaagctatgatactgatgcacttcctcctaaaaataaaggattttgttgcttagaggacatgggccagatgggtcttggcagcatttctcacctagtttcaatgagatttcaccagtgccctcagatacaggtttgcaggttaaggattttgttttgtaggagagataggatagatggttctgagtggctttcaacactgactactattctcttttagccagcagtgagtagcttactcagaattgtcccctatctgtgtgtgtgtgtgtgtgttttgaggtggggtctcactctgttgcccaggccgcagcagtgtatggctggatcacagtttatggcagctttgacctcccaggctcaagtgattctactcgggaggctgaggcgggagaatcgcttgaacctgggaggcggaggttgcagtgagccaagatcatgccattgcacaccagcctgggtgacggagcaagactatctc

SEQ ID NO: 258141 - DNA, 387 bp, Homo sapiens
gagtagctgggatgacaggcatgcaccaccacacccagctaatttttttttttagtagacaaggggtttcaccatgttgaccaggctgttttcaaactcctggcctcaagtgacctgcccatctgggcctcgcaaaatgcacggattacaggcatgggccactgcacctggtcccttctagatttttaaaaatggtttttaacatagtgtatctgtcccctgctacatcttatctgatgtccctcttcttctgtctgttgccttgccatcctacggcagcttcacgtaacttaacaatgctacattgtaaaatctaaggaattctgtgctaagatctctgattattccactaacattctctcatccttcaatttacaatagctttca

SEQ ID NO: 258142 - DNA, 329 bp, Homo sapiens
ttttttttggtcaggggtaaggtgaagacaattcctttgcttctattcagtgatgaacacatgtgctgcaacttacttcctgaattactactaaaagcaccactattctctccctctctttcccaagcaccatcagacattactttttcatatgagttatattgaatgtgccgtttcctgacatgcctaaaagatgcttcaagacatttctttattcacttcccaagtcttcactgttgctagcacacgaaatttattacctcatgggcaaagaccatgctcttacttttagtgaagctctaatcttgctgggaggcatgtgatatatg

SEQ ID NO: 258143 - DNA, 457 bp, Homo sapiens
tgcccctgcctcacccctaccctcccactcttcgcgcgcacaccccggctttcacaataactggatgagcgggcctggcctgcagcgacgacctagtgggccctgcctctccactcccgcggtgatgtaccgttaccaccctcttaaaggagcccaggaaggaggcggacggccccgtcacagagcgtgtagggaaaacacagcacagtgattatcaggacgaaaccaaacaatcggaactccgcagaggtgtagggagatgtgaggagaatgacacagatcaaagagctttttccaagccagtattttccaaaccgcgggttataatctctagcgcattgtgaaattggtttggtagatcgggatcatcaccctccgtttttaataaaattgagaatagaacaaaatagaaaagtttcacagtacatcacgtagtaaaggagttgtttagagaaat

SEQ ID NO: 258144 - DNA, 236 bp, Homo sapiens
  misc_feature (103)..(103): n is a, c, g, or t
cccacatgtacctactcagtccccacaggacaccgatattgcaataatactttcccctgggctacagagagcaggtcagccaggaaatgaatccgggctcccnaaaaggaccgattgctagtaatcttcaaataggactgctactgacaggcaacttgtgaacaaagtaatttgtatctgctgccctgctccagcctggctcaccacagctagttttgtggggtccttaccctttt

SEQ ID NO: 258145 - DNA, 492 bp, Homo sapiens
ccggcggcttattccgagtggaggcctcaaaggaaaacgtgagagagatcacaggcaagcaccccaccattagtccaagactttcaccccacccccaccccatacagatggctgggccgggacacctgcacggcagccacagtctccgcctccgtgcagctctcgggatggggatcacagaatcgggtccaataaggtcatcagccaccctgggcccaaatcgatcaactccaccccacctcaccccatccccagccttaagaacctttttccggacacttttcgctttcgatccccgcctggcgccctatgcctaggaaagtgagcgggtgattcctttctagcgccaggtttcgggtttgccctgctctcaaacctcctcctgccctgcgcacctcgtcgctcaggcctggaacttatgaaaatgtaacccaactcgttgccagaagttgttgctaattagtggataataaacttctgtagccagggcac

SEQ ID NO: 258146 - DNA, 445 bp, Homo sapiens
aattccgggcagctgttttttataaagtggataattcacataattgtgttggggacttccagctatgaagaactgttagaacatttgaaaattagtgttcccaagttgtactgtgatacaaaagcccagtgaattcttcaaacttccacctcttacaggaatctgagaaaaccagataatgtttacatctacgcatggggaaggaaggcttggcagattattggtatcgaaaggaattctttttagttagtttttaaccctacctgtcttgtgaatgtgctatgtacaggctctttgtaagtcttcaaccatgcagcaaaatccatctagccactcaaagattggtaatagcataattgtctaatgtgtgtcttttcaggaaattgaaattgatatgttgtatctccctcatgccaaaattttataaaaatcatttctaagccta

SEQ ID NO: 258147 - DNA, 402 bp, Homo sapiens
gctacccccacccacaggacagtgctggggttgacccgactttggctgcacatttgactggcccctggatcagctctaggactagatgtacccaaaaagatgcccacatccttgcctcagctcctgcctctgcccacccagagagctgccttgcccccatgtccacgatgcagccaccaggcctgggtaagcgtggtgtccgagacgggctggacacccagaagaggagccaggacttgcttggtctgtatcccggctctgcatgcctcagtgtccctgcctgtaaagtgggatctatgggaacccatgtgtgggccgggcacagtgctcacacctgtgaacccagcaccttgggaggccaaagggaggatcctttgagctcgggagacagggtctcgctct

SEQ ID NO: 258148 - DNA, 496 bp, Homo sapiens
atttgggtgcagggggacttaaccttgaccacacgcttcttctgactttactcttaagctgatgatgcaacaacagcaagacagttgatgtttataatcataccaatagccacagtggcctaagaatcagatttcccagaatctctgacctttgccaagtgtattagtttcctatagcttctgtaacaaatgaccacaaatttggtggcttaaagcaacacgtgtattttcttacagttctggaagtcagaagtctaaaatcactttcactaggctaaaatccagggttgtgcttcccatctctcctccccagaggctttagttcgtttctttgcctctcccagcttctagagctacattcttgtgttctttggcccttgggcccttcctctatcttcagagtcagatgcagaataacttgcttctgtccttacattgccttctctctctctagtcaatcttctgcctttttcttgtaagggcacctgtgattgtg

SEQ ID NO: 258149 - DNA, 318 bp, Homo sapiens
ctgatgaagacaggcacaagagagtaagattaagtgaactgaaaacaagaacaaggccaaggacgactgaaggcagggaggtgagaaggagactagcaggaagatgtacagagagcatcaataaggaagtcccaggaacctactagaagcagaccactcatctggctctaagcttcccagcagttggtgctaaaaaggaaatgtgaccgggtggctggttcaacagtgcacgtgagatagaaacaaataggtgtttaggcaaagcagggctcctctgcatcttaacactctcgtctctcaaggttgtgtgatgtaata

SEQ ID NO: 258150 - DNA, 450 bp, Homo sapiens
ttgctcaagtaattggctatagtgattgagagagatggaacatggactcttacagacattactgttgtagtagtcatgttgccttgacagttagatacgacgtctgtttgttgatgtcagtatggaagggttacaacataattaaaagttagaaaataggccagcatggtggctcaagcctgtaatcccagcactttgggaggctgaggtgagtggatcacctgaggtcaggagatcgagaccagcccggccaacatggtgaaacctagtctctgctaaaaatacaaaaaaaattagccaggcgtggtagagcgcatctgtaatcccagttatttgagaggctgaggcaggagaatcccttgggcccaggaggcggaggcgccttgcagtgagcggagatcatgccactggactccagcctgggcgacagagtgagactccagctaaaac

SEQ ID NO: 258151 - DNA, 761 bp, Homo sapiens
gcagtgagaagctgagaaagagctggagggtctggtaggaactcatgtgttctagcttccccattctgcctcaaaggcaaaggggtccctcacttcaactccccaccaccccactaatgactcattttggatggatgcctagttgcttggtctgatggttccttggccccaccatgctagccttgtattcagtcattagggttcgaggtgggggaagcaatggaccacccccacctttgtggagcccattttctcctttgatggttaccaggcccccactcagctctctctcctaccctttgtgctgtgcctgcagcccccgtgcccaagaataccaagcaactggctctggccccctgcccagttcccaggctggctgggtggtggggggaggggactttagatgcggctttgggagaatggcaaaaggggactgcccccccttctcgtatcgtatcaacatcctactggcactaccttcagcatggtctgatgagatcagcaaggccagatctcacctaggctttcaccctatccctctttcatgatccttaggtgagaagtagagaacattcaaggccttccttccactaagataggaactgtggctaagacagaagaaagaaggtcagatgtttgaatggactttctggatttgataaaatgtgacactagtggtaagctcaaaaatggaacttatttccacaatgagtatctatttccttttagtcagaaaagtaaagcatgttttaaaaagtaaa

SEQ ID NO: 258152 - DNA, 227 bp, Homo sapiens
caacaactgtctagtggagatgacagggatgtctgccacctagagggccctctccacattccctagtcctttaagccatagaccttttggaatctgtgaggaatggagaaaatgggctgcaaatggacatgtgatttaagcattaatgtgttgagttgttagtaacggtgtctgtaaagatgtgaaaagtggtgaaacatcattaagggatgtcttaactgctatat

SEQ ID NO: 258153 - DNA, 406 bp, Homo sapiens
gaaggaggtaattcacttggctgatgacaggctgtgaggggctccaggggagagtgctggaaattgaagggagaactgaaggtatacaatccccacctggtgatcactaccttgggcccagcacagaaatgcaacataactttctcctgggaagtatcccttgtggtcctcacacccaaccctcagaaaagcctttagcacgcacaccaacatggcacatgcatacatatgtaacaaacctgcacgttgtgcacatgtaccctaaaacttaaagtataataataataataataataataataataataataataaaatgatactgagttttcactgaggatttcataagggacataggatagattttttttttataatacctaacagacagcattttacttttaaa

SEQ ID NO: 258154 - DNA, 446 bp, Homo sapiens
cggtccacttacttgctggggtagcttgaagcgagagattccagcgttttggggcttggttttctatcttggtctgtctgttcctttctgctgatagagatagaccattctgagttaacggcagcagttgttcaatgggagtgtgagttttttaggcagataaacctgtgaacttgctgggggtcatggcagtatcattctttgccttcttgtcatctacaaggccctgcttctgtctttcaacatcctttaactacattccatgcagactccagccagcctccatcatgatgattttaccatagtggtcaaaacagttgctaacgggtgggaggcagccagtgtgttgcaacatgacatgttgattgggaaggagcaacaggaggacctgctgaattacacattgccctcactgggcagctaagcctcaggggttttgttctttt

SEQ ID NO: 258155 - DNA, 401 bp, Homo sapiens
ttttttctgtaagaactactaaaggaaactgttgtaaataacaggatatatttttgaggctgtggatcatataagaactttgaatctcaccccagggctatttatagctcaaaaatttgttctttttttctatttcaagtgatttttgagaactgactgatatgtcttcctctggtgtttctgtatatgcctgaggtgtgatgtattactggaaagcagaaaggaacactctaagaaagcactttttctaagatgctaagagtcaagggaaaatgaacatacatgttgcaagctgatgcaggaattaaatattccactgtctgtcattcctttttatgagaaccctataccacctgtggtgcctctaacattgggtaacaacctgtgctacgaaagggcag

SEQ ID NO: 258156 - DNA, 301 bp, Homo sapiens
agtagagatggggtttcaccatgttggccaggctggtctcgaactcctgacctcaggtgatctgcccgccttcgcctcccaaaatgctgggattacaggcatgagctaccgcgcccagccgaacaaatgattcttatatgtagattctttagggagcagctaagccagcccccattgactgggggagatgatggtagctttgagacactcctagcagctgcagttttgttatcctgcaccctgttcactttccagggccatgcacctccacggaaataccttatctataagccttgtgtct

SEQ ID NO: 258157 - DNA, 235 bp, Homo sapiens
agatatgtagattgttgttagcgcttcctaccttgcacagcctcttgtcccgtcactggccccatgcatcttcctctgctgccttcaagaagctccagatcctgccacagacgtgctccactcagaggactggagtccaatcccctgacagtgcttttctctttgggaagcaccccctcccccactgccattaaacctctggaattctatggaataaagtaaacattaacttata

SEQ ID NO: 258158 - DNA, 499 bp, Homo sapiens
gctagtagcgaacgcataagaagggcttcctgtatgcctgcgtatcttgtttaagcctaaagatatgtactctctttatcctctttttttgagacgaggaagtagacccagcatgcccgagatcacacattttacaaggaagaagtaggatccagacccagggagtttaacttcaaaacttgaacgtttaacaatcaggtcttgctgccctactcataaagagacccaaataaaaacaacatgacgccatttttttccatgtgtttagactggcaaacttgtgaagtcgcttaataccaaatgtgtaccaagatgtaaggaaatgatgtgagaatgtcattagtataaccttttaggaggagtaatttgacaatatgagaggcttgagcggattgattcagcaatttcaccactaagaaagtatgcaacaattatttttgcaccaatatccaaagatttactacaaagatttctggcagcaatttttgtgtgtgtgtgg

SEQ ID NO: 258159 - DNA, 420 bp, Homo sapiens
gtgccctaaggctctgtttcttctctcccctgtagataggtaagcagcagaaaactgctttatgagccctaattattacctttccccctctttatggaataatcaggtcttatagatccaattattactatatttatacacatcttgcagtctgaaagatcctgtgtggacctcaaaataccagtatttcccctctgaagtattactgtttcttacttcagaaaatgctagaaattcacagtatccctatgctcagaatctatgataaacagcaagatgatctgagattcttttgatttgaaaatagctcagtctcctttgaatgaaacctataccaaatctcactctctagtaatttgtgctgtggaaagtataaaattgagcctaattccatgaaataaaccatgcttgcaaagtact

SEQ ID NO: 258160 - DNA, 356 bp, Homo sapiens
actaaattttagagcatggttttgtttttggaaaactgtgttgtaagtgccaatcaaccaacttttgaaaaaatcaagatacctaaactatatataaatggggagtattctgtacatatagacttatatataaagacatctgtgttcacggatgaccctcaaaatagttaatgccccaccagcatagaccatctgaatatcagccctgtctacacctatcaatgtattacaaaatcagtatagctctacaaaagagatcatgcttatttccccagatgtatttgattttgtatcatataattgtccatgttataatttttgaaaatgtttattaaaatagccatcttttttgatat

SEQ ID NO: 258161 - DNA, 485 bp, Homo sapiens
ttcactccctgtgcaggcctgtgggtgcttctgtcacccctgggagtctttttcctcccagccactccctaacgggtgtagagcaagattggaagataccctggaggaaggcggccagagcctcagggctgactcatgggtagcagaggcctgctccccaccacagcacactgcagggcacaggggacgctgggaaacctttgggctgagtcagacttttagatggggagctccctgtgtggccttgcacaatttacagcctcagtttctcctttcttgagactttctcccagcctcctatagatggaaggcatgaaaggcgtaaaaggaacgcaggtttggatagggtaagatttgaaacctgctgtctccacttgaacttatccatcaattttacttgtcctacacactttctgggtaaatttgtaagttgtagattggtaaaataaagtgactgtttatagagtgattgtggaaagcaggat

SEQ ID NO: 258162 - DNA, 693 bp, Homo sapiens
acaggggccgtaactggggggagctcctgactccaacaccccacccaactccctcctagggagagagagctgtcaacctccaaaaccaacccagggaaggagtgaggtcgaggccaaaacttggacaatctctgcacatcttgcaattcaatctggagcccctttgctgtctttccttttcctgaatctactctcaatgttgacagcactgtgcgatttctgtatttgccaggggcttctcgtgggaggtcggctccagccctctcgagaaccctccggagaccgtggggatgaggcagcgctcagccagagaagccctggagcccaggaccagcgcttcaagtgcaccgggcgggaggcaggggcgcagggagggaggctctggaccggccgcccctgctgactatggccccggtgcaggtcaaggcttgggcccggggatttcctttcaaaggtgacttagagccgcttcattagggtagcgccctcccaggcgggccctaatggcgtgtttggcagagtcagcgaaaagcagcgccctgcggctccagcggcgggggagcgccctcttccgcgccctcgccctctcccgtgtggggcagctgcgcgcacggggccatttgcagcgcaagcagcctagcgtgcggccgcggcgcccaggtcggaaaggaggcggcatcatggagctgaaga

SEQ ID NO: 258163 - DNA, 350 bp, Homo sapiens
acaggggccgtaactggggggagctcctgactccaacaccccacccaactccctcctagggagagagagctgtcaacctccaaaaccaacccagggaaggagtgaggccttgcacaatttacagcctcagtttctcctttcttgagactttctcccagcctcctatagatggaaggcatgaaaggcgtaaaaggaacgcaggtttggatagggtaagatttgaaacctgctgtctccacttgaacttatccatcaattttacttgtcctacacactttctgggtaaatttgtaagttgtagattggtaaaataaagtgactgtttatagagtgattgtggaaagcaggat

SEQ ID NO: 258164 - DNA, 440 bp, Homo sapiens
ctgtgtgcagtgactcaaacctgtaatcctagcatttgggaggccaaggcaggaggattgcttgagcccaggtgtttgagaccagcactggcaacatggcaagaccctgtctgtacaaaaaattttaaaattagctgggcatggtgttgcgtgcctgtagtctaaggtgagaaaatcacttgagccttgaaagtcagggctgcagtgagccgtgttcacacattctgtgaaaattcaatcaggcagaaaagtgacaacgttttctctttgacattgttatgaattgtatctaaatttgcagctctagattttttttcaattttgagggttttgagagcaaactgcctttttttttttttcttttctctttttttcttttgcccctgccagacatggtttttctctgtcgcctaggctggagtgcagtgacaacgatcaca

SEQ ID NO: 258165 - DNA, 329 bp, Homo sapiens
ttgtgtgatgagtgttctgaggaggggaacagagatgcggggagctggcttaggagtgtggcgctcctcagtgcgcagtgggagccacaccactcctgccttctgcctggcctcgcaagttcagagctgctgccttgtcaagaaaaatccactgtgccaggccccattttttgttttttggttaactccctgttcattaaaaaaaaaaaatctatatctatagatagatagatatagatataatctttgttatcaatttgtataagctctttggaaattagtccttcgattgtcatttgtattgcaaacacattctccctccccctgca

SEQ ID NO: 258166 - DNA, 640 bp, Homo sapiens
caaaaatatatgtatatgttccaaaaggaagatcagtgaaggtgttccgatgcttacatgactaaggtaattaaacatctacatatgtgaaggatttttgaggaggggatgtaaatacaatggatattataaggacagcagtcctagtatgttcctggtctgtggacctccttccttatccctgcacctttcctcctctatgcttgtgtatgttcacatgcatgagtgttcatgtgtacatgtgtgcacgtgtgcatgaccatgcacatgcactgaaagatggggatgtggggaggataagagcagcttaccctatttctcatttgtggaaaaaacttttactccattggatttggtaatcaaaaagctactgggggccaggtacagtggttcacgcctgtaatctcagcaccttgggatgctgaggtgagagggtggcttgagcccaggaatttgagaccagcctgggcaacacagaaagactctgtctccacaaaaactaaaaaaaaaaaaaaaaaaatcagtcaggcctggtggtgtgtgcctatactcccagctacttgggaagctgaggtgggagaatccttgagccagggagattcaggctgcagtgagccgtgatcgtgccactgcactccag

SEQ ID NO: 258167 - DNA, 427 bp, Homo sapiens
gcattcagctggccccaggatactgatcacagataaaactaccagagcacagttatataatatatgttacatatcttgtaacggaaagacaacaatcctttatttgtaacatcagtaatctgagcaagatagctttgggagcattctataaccagtttggcaacagcaagctgtagagcgggccaatgataaatcacattgaatcatcatttgtgtggccaatgcaaggagtctgcagtatgagcagcatgcagctgccaatttgtgatgaacgaggaaaggtaaaggttaaaagaacacattcgcacacaaaaccttgtgttttacaggcaacttcaaaataaattaggaagatgggctgctaatgggcaatatgactctaacctgagacctctatcaaaaaaaccccaaaaaacaaaaacctgca

SEQ ID NO: 258168 - DNA, 457 bp, Homo sapiens
tcaattcatatatttatcattaagaaaaaggtttaaagtgaccccaacacaggagaataccactttaaaaaaaacactaatacctcagatttgtggagaaattagctaaatcatttgaaaggtcttatagtttaccaatttggatcagttcactgcagtagttcatcaaaagtttttctctgttgtattcaaaagcttgccatattaccccaaatatcctgtcttcaaagagtttaacagttagtcattgtgaccaccatctatttatgattaaagcaaggttatttaaatttaatggctaaaagcgattttaagccataatacttttcaacctaataatctacagtgtgaaaaatggcactctcaaactggtagtagattttaaacctgcagtacttaaattatgcaagatccatacacaagtcaattcttgtcatgtctccaattaaaagaaaaa

SEQ ID NO: 258169 - DNA, 689 bp, Homo sapiens
gaagggtggaatttcttcttcacaaaatgttatctcaatgctactacttcagctgtaccttttgtaggcaattccaaaagtgtatgagactaggtgcattagcatgatacagtatgtgacatagccagtggaacccatacccatggttatgggaccactgctgtgcctccttcacgtgaaaattcttcctggttactagccatgtcttgtcatatgggagtttataccaatgtatcaggtatagcgtaaacctccagataattggctagctgaggttgtttgggtagaaaatgtaagttcatatattaaatatgcctacagctatgagaatgaactgttggcctttctaagacagaaatgatgtgatgtaatctactttccaccaaaggcctggttggtctccttaaactataattcagtatcaggaattcagaattatgcagcattctcagtattatggagaactgcactacttgttcatgaagtttgcctgtcctctctggtccattcaagttcaatgcctctggtggtattatgaatggaattatgtaacccccaaaaatatatatatattggagtcagatcctcaatagctgggacaattaagctggacactgcatttttctccatacctattaataaagatcatcgaaagcagtttcatttctgttaaaaggactagcatttgg

SEQ ID NO: 258170 - DNA, 487 bp, Homo sapiens
gtgactccccacccccatttgtcctatattaaataacacgggttccaatcttctttaaattttcatgatctggcttcataataaagctttatagttggttcttaccagttgtatcaccctggggaaggagaaagaattggatgttcattttgcacattattttaacctcggctaatggaaactttctctaacttcctgtgtaggtcagcaatttaaagttggattatccatagaaatcatatttcattgtaggttcatcctagaggttctaaactaggaaaggaatggactgggggggtctcaggtgagggtgtgtgaggacccctgctgctgcttctctggaggttaaggggatttattacactcagtcctaaatgtttcaagtgcagaaagagctgtgtaagtcctaaatgttagcggtggaggacatcttaggcatgaaatactctttcttattgccaataaagaaattaaagcttttggttgt

SEQ ID NO: 258171 - DNA, 312 bp, Homo sapiens
tattcagtcataagagtaaaaagaaaaaataattaaaaagcttaaagaaaacctatgggaattgtgggccgccaacaagcacgccaacatacacatcactaagcctaaatttccccatctataaatgggcatagggtctttattacaggattggtaagaaaattgaatggaattgtgtttgtcttgttttagtaaataaatcttatgctttatcttttaaacaccttattgaggtataatcaatacactggccattatattttaaaataacctttctttctccttctctctgtcttttcctctgaaatatct

SEQ ID NO: 258172 - DNA, 707 bp, Homo sapiens
atagcatagtgtgctgacaacttcaacttgaaaagttattaagagagggaaaagccattaattcctgagtttagtttcaggtacatcagaatttcctcacttcagatgaaagctaaactctgcaaactttcatggtaatttccaaaaaatttcatttcaaaagtttaaagctggaaactacagtgcctaaatgatcttgctaccacttcccctgccaaacgcctctcttgccccatctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcaccctcactgcccaagaaactatcaaactcctgagccaacaacttaatatgactagcttacacaatagcttttatagtaaagatacctctttacgggactccacttatgactccctaaagcccatg

SEQ ID NO: 258173 - DNA, 399 bp, Homo sapiens
gagggccagttcttctgccacatctctctgatttcagctagagaaaatatcctgcttttcagggctcagattagatttagtgcacacagagaagccaggataatctctttattttaaagtttgtaattttaattacatctgcagaattccttttgacatgtaatgtagcatattcacaagttctagggattaggcacgagatgggcattctcctaccacagccgggaagagcagtttcagaggttgccttccctaggtgatgtgggtgttctcagttctcaaatttgtctgttttctctctagggttcactttctctctagggttcacgttgaaagtcgtgattcttggtgccttgatttattgtgctcatagggttaaaaaaagatttgcattagaat

SEQ ID NO: 258174 - DNA, 385 bp, Homo sapiens
aagatattaacaatcaacccaaagagttcacaggatatccttttcagtaagttgttcttatttatttttccataaaattatgacctgattcattatcttggcattgatctataactacagttctttggaaaatatataaggtctgaagtcaggaaaacatctcagaagcattcactctaccatgtaaccattaatttaccctgatttggaaaaatagcctgaaaactagtgaatgcttccatctcaggagaaacttcagtgtcactagatatggtaaactgtagtatgctattttaacaaaatccagagcaaaaaatggatgaatccaggggaactacctatagcaccatctgaggcttaggatgttaaaaaaaaaaaaaaaaaa

SEQ ID NO: 258175 - DNA, 717 bp, Homo sapiens
gaatcatcaatggatgctaaaattaataggtgaatgtataatgagaaacataaatttatatagtctcaaagcatttcttcataaaatgccttttaattattaaagggaaaatagtaacttaacagtggagaaacctggtggacaccatcttaaccacgtaattgaaggtaacaccaccagtaataagacatacaggcatgacattcctccacactgagaagggtacagcatcacttctgcggtatttctgccacatgcaaaaacatgagacacccaggaggaggaggtgggaggcagacaggaagagagggaagaaaaagggataggtattggtggaggtttgatactaccacctccattaagatgttgatagtgaagacaggaagatgtggaggcagtacgtagattacaagaaaaattgtgaatcaacagaatttgaggatcagtatcagatgagaaacaatggattctgaagagagtagaaggaggtttaaggaagatacccagatttgtgggctgatgtacaagtggttgatcttgccttgtattaacaacaggataaattggaggagacaaagttttagggataattatccactaatttaagattctcaattcatcagtactgcaatcccaagcatgtagcatatccttagtgaagtcttttattattttatttgtttattatttcttattatattattagggtcagataat

SEQ ID NO: 258176 - DNA, 414 bp, Homo sapiens
tgaccttgtgaaaaaataataatatttctacttaatagagttatgttgaaggtataatgagatagcatatacaaagagcttagcaaaatgccttccccacagtaagtgctctgttaatagtttgtgtgggccaggcgcgatggctcacgtctgtaatctcagcattttgggaggtcaaggcgggtggatcaactgaggtcaggagtttgagaccagcctgaccaatacgatgaaaccccgtctgtactaaaaatacgaaaattagccgggcgtggcatgtgccggtagttccagctactcaggaggctgaagcaggagaatcacttgaacctgggaggtggaggttgcagtgagccgagaacgcgccattgtactccagcttgggcaacaagagcgaaactgtgtcttaaaaaa

SEQ ID NO: 258177 - DNA, 114 bp, Homo sapiens
  misc_feature (44)..(44): n is a, c, g, or t
  misc_feature (49)..(49): n is a, c, g, or t
  misc_feature (52)..(52): n is a, c, g, or t
  misc_feature (56)..(56): n is a, c, g, or t
gccgggtcgacacggccgtgtattactgtgcgagaggggcccantaggntcngctngttactccttctgactactggggccagggaaccctggtcaccgtctcctcagggagtg

SEQ ID NO: 258178 - DNA, 126 bp, Homo sapiens
gccgggtcgacacggccgtgtattactgtgcgagagcgtctccgtattactatgatagtagtggttattaccgacgacttgactactggggccagggaaccctggtcaccgtctcctcagggagtg

SEQ ID NO: 258179 - DNA, 121 bp, Homo sapiens
gccgggtcgacacggccgtgtattactgtgcgagagttcagagggtcttcacgcggtgacttagagaatgcttgtgactactggggccagggaaccctggtcaccgtctcctcagggagtg

SEQ ID NO: 258180 - DNA, 100 bp, Homo sapiens
gccgggtcgacacggccgtgtattactgtgcgagagttccgaggctacactttctggaatccttcttcgctactactacatggacgtctggggcaaaggg

SEQ ID NO: 258181 - DNA, 399 bp, Homo sapiens
aaactttcccaaagaaaaaaaataatctctaggtaatgctcttaagaattcttagaaagaaatctttattctttgagcactcttctgggaaacctaacctgtgattactgttaggactcaaaatgtttcaccacctgcatctacgtagataggatgaggagtctggggaaataatggagccaataggcttttagcttgaggagcgtggattctaaagccagggacactcatgaaaacaaccacctggcggattacaccctaacgttgaaactgtggcaaagtaccttttaattgcaaaagggtttaggcagagatttatctttgagttccttggcaataaatgtttacccactttaccactgttactatagaatggggaaggtttaaggtagaaaattt

SEQ ID NO: 258182 - DNA, 615 bp, Homo sapiens
tctcaatgaatgatcgggctgcttgtttcttttaaaacatttaagaagacagctgcttttgtcaacctagcacgtgagggtcctggtcaaaatttggtttcaatagccagggcccatgggaagcccgcaagagctgaaggcaaaaacactggaaagaattagattaaacccaagaaaacaccaaaatatcaggataaactgccccaggtgagcaccaggcctcctggagcccccggccttgtcccacaggaggcccccaaacccagatgcctacgttgagtagtctgtctggtccatcaccacccctagggtgggggctaaagaggcaggtgggagacagtccggggcccctcactttgaactgataacagccacctcatcccacagattctcaggtgaaaaatactcattagccataataagcagcttgatcatccgacacagccttgtcccaaataaattaaattcctttaccttgagacagtcgccccgaaaccagactaaccacctttcccaacaggacgctgctttcaaaaactaaaccaccccccactaaaaaaataaaaacacacaccccagagccagacacacaaagatctttgcagagaacaaaaa

SEQ ID NO: 258183 - DNA, 683 bp, Homo sapiens
gaaagaaaagaaagaaagaaagaaagaaagaaagaaaagaaagaaagaaagaaagaaagaaagaaagaaatttgtaatttctgtctgacatttctcaaaaggtttctgtgcagtaccagttcttcttccaccatttgctttcgttttagtgtccatattatagaagagttcatgtcgtgaaagaagtcaaaagcaatcttgaataagcggaacccttctgccagatggtctaacgtcaatttgctttctggcactgcttcttctatgtcttcatcctcattgtctggcactggttcagaagcactcatctccatcaagtcatctcctattagttcctctagcgtggtgtctattaactcttgaatttttctaagatccatatcttgaaactcttctcccactacattttatgccatatccaaatctctttcatgatttccttgatttgctctgttgtgtatcttcggcattcacgcacacatctggacacagttttctccagcaggaatttattgtttcgggttgatggctttcccagctttttctatagcaatggtgatattttcagtcctgcaatccttctagactttcattgacaatcttttccatagggtgctgtgtgtaatgagtctgaggggtccttatgaactcctgatctagacgctgagttaaagatgctgtgc

SEQ ID NO: 258184 - DNA, 148 bp, Homo sapiens
gatcgcttgagtccagcagtttgagagcagtgtggacaacaaagtgggtccctgtctctacaaaaaaccgacctattaaacatgcattatctatttctgtgaataatcactttatttttttttttatttttgagacggtctctcactc

SEQ ID NO: 258185 - DNA, 788 bp, Homo sapiens
tacgaatttggggactaagtttccaacacatgaaatttggggaatacattcataccatagcaaatacaaattcctttctcatgaccttcataatgccttggtcaaaaataaaggtcactggggtaatgcatagggatgcggaagtttataattacagggggccaagtcacactgaccattcataagtgaggcaagcccttttacaatctccctgaaaatgatcaactaatttctccttaaatattttcagcaaactaacaccttaacaaggcagctcacaaattataaaatatcagagagaactgaaattcatctccccaaaatttgcaccaactttgtaactgccatcactcaccaggccctgattttcttcttaggctttagtaaaatcctttttcccagctcaccctgaatgtctatttttaaaacccagctcaaaccttcctgatatttaccatcaatagctgtgacttagacttatttgggcttcagaagattccaagctactttctccagattctatggatacttctatcgcagctggtgtgtctggcagctgagcagacctacaattttaggagaagcatctcacaaataacttagtgcatcaatgtatgtggttctaattatcagttgccccgaccctctcacccgctttacttaggaaccatatgaatgtgcaaaaggcagataacaagagacttgtagtattggtgctcatggtctatcaaatctctaacttttaaaaacatatagtggatcacgaggtcaggagatcgagaccatcc

SEQ ID NO: 258186 - DNA, 612 bp, Homo sapiens
gggggggggctggctgtcagggaggccgccccgtcctggggggcacctcagggcaggtactgacttccatagccaggacctaggccgggaatcgggaagggatggccccggaagtgataaggcaggatttccaggcaggggaagtggcatttaggagaactggctatttaagggggcggtcagtgctgacacagacaaagcattcactggctgggaatggccgccacccagtggctctgagaactagacttggaagtctggcactgggagctgtgccaacttggaccaaactttgggcgcaaagcacgacgtggcagacgaggaaccacactagaacgggccacgcctacccaagatttacgaggccgtcctttccctcatgcaatcgcaatgggaaaaggaggaaactaaggctcggtaagcaaaagcgttggtgtgtggatacctccagccccaaggccgggaaagcggccctggagaccgggggcgccacgtggccccgcccccgccgcgtgcgcatgcgccccgcgcgcaccctgcgccactccatccgggaactcggcgctcccgccatttcgctgggcacagcctcgagctcgcggccgccatttt

SEQ ID NO: 258187 - DNA, 642 bp, Homo sapiens
gggggggggctggctgtcagggaggccgccccgtcctggggggcacctcagggcaggtactgacttccatagccaggacctaggccgggaatcgggaagggatggccccggaagtgataaggcaggatttccaggcaggggaagtggcatttaggagaactggctatttaagggggcggtcagtgctgacacagacaaagcattcactggctgggaatggccgccacccagtggctctgagaactagacttggaagtctggcactgggagctgtgccaacttggaccaaactttgggcgcaaagcacgacgtggcagacgaggaaccacactagaacgggccacgcctacccaagatttacgaggccgtcctttccctcatgcaatcgcaatgggaaaaggaggaaactaaggctcggcctcccctactgagcctggttggcggaggggagtcttaaagccgccgccatctggagaaccagctttacaaggaccctcactcactactcttcggcggccccaaagcctctggggggccctctatggccaccacttgctcctcgcccaggagtcatctcatgccgccgcctcccccagccctggtggaagaagccagcgcggacccctgcctctctgccccaga

SEQ ID NO: 258188 - DNA, 368 bp, Homo sapiens
ggtttctctaattcgggcagtctgttctgctgatttagaaatgggaccccttccatgttcaatatcactctttatgtataaaccacaagactaggggaagtagagtgacactgatccttaaataaaatttctgccacaaaacactgtgaatgaatttgaaagtaaaaaaaaaaaagttagagaccagataaaatagagttgatatcctttttacaagagtattttcaacaaaaaccacaatttacaaacaagtgtgtgataaacattcagagtggactgaggataatataagcaaagcaaaataatatttaaaatataaagccatgatccaagaaaggctctttcaaaaacaattgccaattctcttc

SEQ ID NO: 258189 - DNA, 517 bp, Homo sapiens
tcacatttgtcatttcctgtcctatgatgctcttcctgcagatatctacagcagctccccgctgctccttttgcaggtttttgttcagatgtcatcttcctggtgagctcttccctgaacaactcctcaccccctccaccttgcccctgggactccctttgacctttctcggattgttttccctgtaactcttgccaccacctcatacagggcttctcaagcttggcatgattggcattttgggacagttctttgttgcgggctattatcctgtgccttgcaggatgtttagcagcatcaccaccctcgacccactcaatacctgcaactttcctccctaggttgtgacagccagaaatgtctccagacactgccaaatgtctcctgggggacaaaaccacccctggttgagaatctttgatataatgtaaatatgcattttacctatgtatttgtttattgttcctcccttccccaccaataaaatataatctccatgagaacaggaatttttgtg

SEQ ID NO: 258190 - DNA, 514 bp, Homo sapiens
atcaagagttcctttgtggcagggcaaatgttgtagcattactgccaacagcacacacatctgtaggtggggttgcatgttgtatgcaccccaaatattgcactgtgtctttaagatactgatgtatattgctctgctaaagactggtggttccagagaagaaggcatacaaaattgtcactgattcagcaaacagaaaagtcaagacacaaattgacatatacttatcgagtcaatggatgttgtgtgagtaatttgatttacacaattattatacctcaatacaatgtagtggcagtttaaaaatatattttaattgtccttgtacatgcctcaatttaagattatatattatataatttttcagagtatgcagccaaaaaatagaaaaaacagttgtatcaggaagttaattgtaaatacatatgcatttttctggattttatgaagtttattgtatttgccagcttttaaaacattttcaccttttgtggttaattttttccactccaaa

SEQ ID NO: 258191 - DNA, 376 bp, Homo sapiens
cagtatcagtgattggttatagttagcctgatttctatgttattgaatttattatgtcttttttgaaatagtattggggtaaaataaacaccacaagtcaataagcttatttagttggtgggaactcagctatctcatctggaaggttagatagcctaatacataagacagccaagccacagtactactttatacatagactctaagaatttagtgctaaaaaagatgtaggaataagctagtgatggcatagttttaagtagtaaaaatgtccaatttttaaaatttcagaaaatagcatattcaaaaatgatttgagttcaagtgaaacttaagtatggcttctaataagacccgagggtgaaacctttgtatg

SEQ ID NO: 258192 - DNA, 944 bp, Homo sapiens
ccctcctctcaaggtgactcctcccctcagtgtgacccagccctcctcagtgtgagggttccgccctccacgtaggaacacggtctgccccctaaggccggaggaggggctgcaactggcctctttaagtcggcgcggtgcctgggtgcgcacgcagtctcaggactccgtgcactcgccgtaccagacgcttccggttctgccgctggttcctcctccggcctcggcgaaatagccaatcatcgctagggttgggtggtgacacgcgatcccggcggtccactccggggcaaacggtttaaaagggcgtcgttgagccgcctgccacctagcggcggaacggtgggcggagggagagaaagctgccgtctcgagtgcggaggcaggctgagagctcctcgaggaagcgaggctgagtcctgcaggaattctcaagtactgtattgatatttctgtagtaagcttaaaagagaattaatacaagcacagtccgtatcgcgtggggttaccgtcttccaatggagtctggttacacgtttatgagacttggagccaagaaatactactcgcttgtcgagggctactgagaaaagaataaagacggtcataaatgatacatgatgccttagagtcaagagaaggccagatgctgtcttggtgcgctgtacaagggaaggtattgcacaagtttggagcgagaggaatgggagacattcgcaatccttccacagccggtggaggcaggccaacctcacagaattgcacggggcacgtgcatcctgttcttttttctggaggcgtttggtcttcagcacacgctcattcatcacattaatgttaacatctacaactaatttgtgaatttgctttttattgtatgacatctgtaaacactaggaatttatgcctcattttgtttaatatcatagatcttttaaccgaca

SEQ ID NO: 258193 - DNA, 436 bp, Homo sapiens
tcctgttgtagcagttgtaccttcgagagggtgttctctgcacacacttactttcaactcttcctaaaggtataaacatgtggcatctatttttaaatggccattaattaaaaaaaaagctggcactcttctagaagtgaaaaattctagtaatatgatacctactagccagaaaataaaagttttaaaggacaaattatgttctccagtggtatttgggaacttgcaggaaacacaaggatttaaaaagagctgatcaatagaaagttctaaaatcatatcagtgttccatatctgctctatccaatagctgcttgaaatgtggctcacctgatagaggaactgaattttaaagtttaaattttatataaatttaataaatgtgaattgaaatgtaaatagccatatttggctaccataccgggcagatcaggtt

SEQ ID NO: 258194 - DNA, 407 bp, Homo sapiens
ataaaaactgctacacaggtttgtaaccaatagcctaaggtaaaacctggtattaataaacatatggcaatgaatcaagccacaactatctttattcacatagggatctatggactgtaaaaccaccaccgggcgcagtgcctcacacctgtaatcccagcactttaggagactgaggtgggcagatcacgaggtcaggagttccagactagcctgaccaacatgatgaaaccccatctctactaaaaatacaaaaattagccaggtgtggtggtacacgcctgtaatcccagctactcaggaggctgagacaaaagaattgcttgaacctgggaggcagaggttgcagtgagccgagatcaggccactgcactccagcctgggtgacagaatgagactccatctca

SEQ ID NO: 258195 - DNA, 228 bp, Homo sapiens
tctgaggctgcaggtaccaaagctgtccctgctcaatcctccctctcggagtgggctttggtttttgtgggcgactccattgttaaaagccagccctacaatgggacgaggacagttgacaggtttctgtgcaagcgcgtttccgatcgcgcaaggtaacagcttcattactcagtgatgagtgacccatatttcctaacatgatttccctgctgtaactcaaaaaaa

SEQ ID NO: 258196 - DNA, 684 bp, Homo sapiens
tgtatcacaaatactgcatcagatatacttgtactgaaaaaaatcaaaacaaaaacaagaactacagcaacaaaagcaacaattgttatttaactaaaattcaaattctgccgggtgtcttatatatatatatttttctaaatctgaccaagggaaaacagaaaggggtggttgaagcatgaaagggaatggaaaagagacaaacacggctgtaatttcaggagaagctccaggttcagcctgattgtgaaggaagctttcagtgtgccagacacctcagttagtcctgcgtcaagcaaaaggagctgggcgtctgggcttccacattagttatatgagttggttattaagaattaacagtaggctctgtgtatgattggggtagggtagggatataggtaaaactctcaactcacagaccttgggatcttcctaccagctgatatgcggctccagtgtccaagatacctttttgaatatgtcaggtctaatcagtatcacttcatgcagaagcagagggatgaacgtacagatctggtaaaagggacaggaagggaaatagctatggcaataacagtgtccacaacattatcttaagcgtgatggacatttgttaaaatgcttttggaaactcatagtgtggactgaaaactggaggccccagcaaattgccaacaggggacg

SEQ ID NO: 258197 - DNA, 410 bp, Homo sapiens
caggcatgagccactgcacctggcttagactggataatttttaaagaatagaggtttatttagctcacagttctggaggctgggaagttcaagagcatagcaccagcatctggtaagggccttcctgctacatcatgacatggttggggatgagagtgggcatgtccactcaggtctttcttccttttataaagccatcagtcccatcatggggccctgccctgattaccttatatgatcctaattacttcccaaaggcctcacctctaaatactataccatcgacatatgaatttggggattaagtttccatcatgagatttgggagatgcattcaaaccatagtagtgattttcatcctcttctctaaacatagtgaaatttcagaacaggctgggtgcagtctcaga

SEQ ID NO: 258198 - DNA, 886 bp, Homo sapiens
cctgtgagtgtccaggatgcatgagagaggttgttgtgagacctgccttaaagggtggcggtggcacgtgtggaccttgctttctgagtttcactctctgagtcccagaggtataagcttgtgaagagaagcgtgtatgtatgatcacactaagcagatacttgctcctgcactgttggaggaggaagaggagttaatttcatcaattaactcttccaacactccttccatttagtaatagcatcacttgttcctgtcttttgttccatggccaagctccacaaggtgaaattgaaaatcgagtgcaagacactggctgtgctggagttgaggaaagttttgctggagacctgcttgcaccatatgtctggtcactgatagatgaggactggccaggtcaggacagctgacacttggagaaggggctgcccaggagggcatgacagactctggaaaaggagggtcggagtattaaactggctgggaatgagaggcctccaatcttttcgcaggaaaaaaaaaaaggcttaatgctcgtgctgtggaagtcagaatggagcaaagtgggttctgtctgtcttgctgctgtgagtgtgtgatggaacaacagtgtcatttgctttttctcagaaatatttaatgcatgtttgtgacataatttttcaaagtaattttaagtaaatattttaaagtaaaaagttctaagatttgtgtctcaaggtaaagtctcaaacgttctttggtcactatttaatatgagattttgtcctcattttaaatggattcatgtaagcgtcctgtggaagaagagttaatagttatccttggaaaataagaactttttatgcctcagttaggtcatatggtttaggatctgattttgtag

SEQ ID NO: 258199 - DNA, 689 bp, Homo sapiens
tcttgaccatgtgaggcctcagaaattctgctataaaaaacattcttattaaaactactcttggaagaagtattcaaataagaaaggaagcaaatccaggaaaatactgaagtaatataggagttaacaaatatattggcttaacaatatataacaatatataaggcttaacaaacatattgataatattcagttatctgaacagccaaataaataaaaacctgcctctgccctaaaaatctagatataaagaaaaggaaagcaagtattattagttgtctttattatatattagaatcaagggcatattgtttagctatgtcaataaaaacaagtagcagtaggcttttataggctgatctttaaaataattttcttcagcaaatacattctgtcaaagaatttatgatttaaatttaaaaataaaatttatttgtaacggggttaaaactttatttaaaaatttaatgtaaggcaataatcgcaaaacatgagaaatgtgttctttaatttcagtggctgatatgcaagttaatgaatcatttatttgtttcttacaaggcaaagctaaacatgtaagaataaaggttttcagaaagtagacttgaaaacaattcatgcattcttgagaaaattttaatctgtttttaatttgtaaccttgtgatgattaaatacagtcaatccata

SEQ ID NO: 258200 - DNA, 420 bp, Homo sapiens
ctttaactcaagacaggatggtgatatgcaacagttataggcaaaaaatatttacatttaagaaaaaaagtatcatttaatcccattaggcagaagtggagtcaaaagcaaaaatatggctggttatggatgtatgtttcccttcctgttcatatgttgaaacctaattcccaatgtgatgggttttggagatggggtctttgggaggtaataggtcatgagagtggaaccctcgtggatgggattagtgccatataagaagagtccatagagctagctcactccctttctgccatgtgaggatacaagaagtcggcctggaaaagagccctcaccagaaccctacaatggcactctgatcttggacattcggcctccggagctgtgagaaataaattgtctttaagctatccagtttat

SEQ ID NO: 258201 - DNA, 2364 bp, Homo sapiens
  misc_feature (37)..(40): n is a, c, g, or t
  misc_feature (42)..(42): n is a, c, g, or t
  misc_feature (235)..(235): n is a, c, g, or t
  misc_feature (657)..(657): n is a, c, g, or t
  misc_feature (789)..(789): n is a, c, g, or t
  misc_feature (1009)..(1009): n is a, c, g, or t
  misc_feature (1120)..(1120): n is a, c, g, or t
  misc_feature (1618)..(1618): n is a, c, g, or t
  misc_feature (1677)..(1677): n is a, c, g, or t
  misc_feature (1858)..(1858): n is a, c, g, or t
  misc_feature (1877)..(1877): n is a, c, g, or t
  misc_feature (1913)..(1913): n is a, c, g, or t
  misc_feature (1999)..(1999): n is a, c, g, or t
  misc_feature (2249)..(2249): n is a, c, g, or t
  misc_feature (2266)..(2266): n is a, c, g, or t
  misc_feature (2279)..(2279): n is a, c, g, or t
  misc_feature (2283)..(2283): n is a, c, g, or t
  misc_feature (2324)..(2324): n is a, c, g, or t
  misc_feature (2344)..(2344): n is a, c, g, or t
  misc_feature (2364)..(2364): n is a, c, g, or t
gatgatcccaatagcagtgatgaatctaatggcaatnnnnangctaattcagaaagtgacaataacagcagtagccgaggagatgcttcttataactctgatgaatcaaaagataatggcaatggcagtgactcaaaaggagcagaagatgatgacagtgatagcacatcagacactaataatagtgacagtaatggcaatggtaacaatgggaatgatgacaatgacaaatcanacagtggcaaaggtaaatcagatagcagtgacagtgatagtagtgatagcagcaatagcagtgatagtagtgacagcagtgacagtgacagcagtgatagcaacagtagcagtgatagtgacagcagtgacagtgacagcagtgatagcagtgacagtgatagtagtgatagcagcaatagcagtgacagtagtgacagcagtgatagcagtgacagtagtgatagtagtgacagcagtgacagcaagtcagacagcagcaaatcagagagcgacagcagtgatagtgacagtaagtcagacagcagtgacagcaacagcagtgacagtagtgacaacagtgatagcagcgacagcagcaatagcagtaacagcagtgatagtagtgacagcagtgatagcagtgacagcagcagtagcagngacagcagcaacagcagtgatagtagtgacagtagtgacagcagcaatagcagtgagagcagtgatagtagtgacagcagtgatagtgacagcagtgatagtagtgacagcagtaatagtaacagcagcganagtgacagcagcaacagcagcgatagcagtgacagcagcaacagcagtgacagcagtgatagcagtgacagcagcaacagcagtgacagtagcgatagcagtgacagcagcaacagcagtgacagcagtgatagcagtgacagcagtgatagtagtgacagcagcaacagcagtgatagcaacgacagcagcaatagcagtgacagcagtgatagcagcnacagcagtgatagcagcaacagcagtgatagcagtgatagcagtgacagcagtgatagcgacagcagcaatagcagtgacagcagtaatagtagtgacagcagcgatagcngcaacagcagtgatagcagcgacagcagcgatagcagtgacggcagtgatagcgacagcagcaatagaagtgacagtagtaatagtagtgacagcagcgatagcagtgacagcagcaacagcagtgacagcagtgatagcagtgacagcaacgaaagcagcaatagcagtgacagcagtgatagcagcaacagcagtgacagtgacagcagtgatagcagcaacagcagtgacagcagtgatagcagcaacagcagtgatagcagtgaaagcagtaatagtagtgacaacagcaatagcagtgacagcagcaacagcagtgacagcagtgatagcagtgacagcagtaatagtagtgacagcagcaatagcagtgacagcagcaacagcagtgacagcagtgatagcaatagcagcgacagcagtgacagcagcaacagcagcgatagcagtgacagcagtgatagcagtgacagcagtgacagcagtgatagcagcnacagcagtgatagcagtgacagcagtgacagcagtgatagcagtaatagtatgacagcngcaacagcagtgacagcagcgatagcagtgacagcagcgatagcagtgacagcagcgatagcagtgacagcagtgacagcagcaatagcagtgacagcagtgacagcagcgacagcagtgatagcagtgacagcagtgacagcagcgacagcagtgatagcagtgaaagcagtgatagcangatagcagtgacagcagcnacagcagtgacagcagtgacagcagtgaaagcagcnacagcagtgacagcagcgacagcagtgacagcagcgatagcagcgacagcagcgacagcagcgatagcagtgacagcagcaatagnagtgatagcagcgacagcagtgatagcagtgacagcagcgacagcagcgatagcagcgacagcagcgatagtagtgatagcagtgacagcagtgacagcagcgacagcagtgacagcagcgacagcagtgacagcagcgacagcagtgacagcaatgaaagcagcgacagcagtgacagcagcgatagcagtgacagcagcaacagcagtgacagcagcgacagcagtgatagcagtgacagcacatctnacagcaatgatgagagngacagccagagcnagtntggtaacggtaacaacaatggaagtgacagtgacagtgacngtgaagcagtgacagtaacnactcaaccagtgatgattan

SEQ ID NO: 258202 - DNA, 563 bp, Homo sapiens
gcccctggtgtgctccaagcactgtgcttggtacctaagttgcaggggcaggtaaaatactcaccataaaactgtaaagcaagcaggaggcttgtatactgagacccactttcacgttattgtcagaatgtgtcatttttgcctgcgatcctgatctggaggcagaattgtcaggtgtggaaggcagaataacacaacccaaagagctctacatcctaatcccttggatctgggaatatggtatgttacatggcaagggagaattaaggttgcaaatgcaattaaggttgttgatcacctgcccccttgagaaggggaggttatcttggagtatctcggcgaacccagtggaatcaccagtgtccttaaaagtagaagaaggctgctaaagagagagagcctgagagatagcatcacgagaaggacttggctcaatgttgctgactttggaaatggaataccctgatttgattttcacacaagatacgcatgtgtcaaaaaatcatactgtaccatatatatatatatatatacacatacagttattatgtgtcaattaaaaa

SEQ ID NO: 258203 - DNA, 601 bp, Homo sapiens
gcccctggtgtgctccaagcactgtgcttggtacctaagttgcaggggcaggtaaaatactcaccataaaactgtaaagcaagcaggaggcttgtatactgagacccactttcacgttattgtcagaatgtgtcatttttgcctgcgatcctgatctggaggcagaattgtcaggtgtggaaggcagaataacacaacccaaagagctctacatcctaatcccttggatctgggaatatggtatgttacatggcaagggagaattaaggttgcaaatgcaattaaggttgttgatcacctgcccccttgagaaggggaggttatcttggagtatctcggcgaacccagtggaatcaccagtgtccttaaaagtagaagaaggctgctaaagagagagagcctgagagatagcatcacgagaaggacttggctcaatgttgctgactttggaaatggaataccctgatttgattttcacacaagatacgcatgtgtcaaaaaatcatactgtaccatatatatatatatatatatatatatatatatatatatatatatatatatatacacacacatacagttattatgtgtcaattaaaaa

SEQ ID NO: 258204 - DNA, 327 bp, Homo sapiens
aaattatttttttaatttgtggcttgcctaatcattttctgtatggtgtcgtctgattagcagaagttttcaattttgaggagatacaattctcttgttactactttctgtgacccaagaaacctgtgcctacccaacatcatgaagatattttcagtgtttttcaccaaatgctttatggtattagctcttataattaaagatccatctcagtgtttatggtgtgtggcagtggtcaggtttctgatacttcttctatatgggcattgcagcaccatttgttaaaaagactttcccttccctttgttgaaaaggtggtcattatag

SEQ ID NO: 258205 - DNA, 479 bp, Homo sapiens
taccctcttcccttttggaattcaggaaaagcccgaccagcattgaccaacacagatcttaagtctgatcagaaacatttacaatctactctctcagaagcccgctacctggatgcttcaagtgcaggataaaaccttggtttacacaacccctcactgtaacccagacattcctttctactgatagtaacactttcaacctgatgccaatcagataatggtttcttttttctttttttgaagcagagtttcactcttactgcactccagcctgggtgacagagtgagactccatctcaagaaaaaaaaaataactaaaacaaattagccgcgcatggtggtgtacacctttggtcccagctactagggtggctgaggtgggagagtcccttgagctcagaagtttgatgctgcagtgagctatgatttctccactgcactctggcttggggaacaacagagtaagacctgccatctcc

SEQ ID NO: 258206 - DNA, 1248 bp, Homo sapiens
  misc_feature (20)..(20): n is a, c, g, or t
  misc_feature (29)..(29): n is a, c, g, or t
  misc_feature (36)..(36): n is a, c, g, or t
  misc_feature (39)..(39): n is a, c, g, or t
  misc_feature (57)..(57): n is a, c, g, or t
aattcgcggccgcgtcgacntcgacgcgngaagatntcngcggccgtgcatagcggnctgccagaagacgacagaagggcaaatgggaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctactttttctggtgttcaaccaggtaaacctctgtttagcaagaaacatcatccccagagtggggactgtcttgtcctttcagaagctagtaccctaagcaagactcataaggaaggtcgggcctccataggtctctgtttcttctgaacagtgatgagctaggtgcagagagagttaaaggtcctatgcagcttgacaagtgtgacccagttcccagtaaattccacttggctggggtttcagaggtgagcaagcaggctttttactcattacacaagaatctagacatccctttaattgggtggcattctgggtgctaaaaggaaggggctttgagaggcaaagatgatgggatatcataaatttttttgttccttttaatgtagcgcagctcctatacttcagatttaactttgaaatgtagcatagctaagatctggtccaaaaagatttctgatatctccatgaatcctagttagggattgataggaaaaaaaaatcttgtgccacagcttcatgctatttttaggaacctttctgaaaccagtggcagcccaagttagagcccagcattaagtccgcctctgcacatctacagttgccagcttatggtaaaagctttctgcaaagcttttctgctcctgggttaaggccttccagcatcagtcacatgtaattaacagctacattgtgtgcttactttttgctagatgtttcataaacattatctcatataaacctcacaataactaggtattattatcccgtatccctgttttacagctgtggaaagtgaagtgaaggatttttgtcatacagccagtaagtgccagaactgacttgaacctagctctctgtcttgattcaggaactactgctctttccattggtggctcctggctaatcaatgtgatagtctttg

SEQ ID NO: 258207 - DNA, 432 bp, Homo sapiens
tccacattctgagccagtaactgccacccaggtccagccagagtctgccttctctggaccccccaactcctgctagtcactgagcatgctcactgcaggtcaagaaagtgattctttaaatagcccctaattaatagagatcaaaaaatttaatgtatgcatttcctttcatccaacaattctagaaatttatactaaggaaataatcagaagtacacataatgatttggctgcaaacatatctattgaggcatccccttagattgcaaaaaaaaaaaaaaaaatttcagggacattctgaatgcaaaacaataagggaatatttaaataaattgccacatagccacatattggaatgttatgcaaacatttaaaaagttgtacaggcattttaatggcatgcagaaatatttgaaatagattttaataagt

SEQ ID NO: 258208 - DNA, 699 bp, Homo sapiens
ctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccaatctgataggtgacataagacttatacacaaataatcataacacaacaaa

SEQ ID NO: 258209 - DNA, 367 bp, Homo sapiens
tgctgtcctcttgttttgtcaaccattctattccagggtttctcaacctcggcactgttggcatttggggctggataattctttgttgttgggaatatgctgtgcattataacatggttagtgccattgttggcctctgtccactagatgcacctcttcccacttgtgacaatcaaaaatgtctttcagacacggccagatttccccaggggtcaaaatcacccctcactctccagttgagaaccactgctatattttaatttttatgtataatatatataaattacaatataaatattgtaattaaaggaaaaaacacttataagtattaaaggaattacatattataaatattgtaattaaagga

SEQ ID NO: 258210 - DNA, 965 bp, Homo sapiens
gtagaaacatcttgtactttgtttaacttgtatacttttgcactaaataagccaagatatactgaaaacagttgggttgaacggcacctatctcctgtgacctgaactctatcaaagctggcatacagtgcccagataaaaaaggaagctgaagtcttgactccatgttcaaattcattttggctcagctctcagcaaattccagggctctcacaacctgtttgtggaccacttgaactttatttatgtaaaaaatcttcagataatgcaaactgccgtaccttttccaagtagaattgaattacttgagatttaaagttaatgtaatggtaatgaagtatttttataaatatattttcaaaattttagctagattgacaatccaagattggtttccctccattaaaagggtgaagaggcatgatagcacctcacacttacaatgaacagttggaaataaaatttacagtttggctatatcccaactagatagagtttttacttattttttgcttttaagctgtggctgggatggtgagagtgcgagtagaggcaaatttctatattcaggaaatttcttgtccttcccactactattaaaatcttgtatcgcttttattgcttcaggatagagcatatgataaaacagacaagcatatcagacaaaaacacagatttttgggcattagaaataacttagtattcctggttttgacttgttttctaggtaaaacaggtcttttgtgatcctttgattaaaaacaggaataagaacctgtaatgaaattatagtatataatatacaaacgcatttgtccatgtgtgtaatagaaatttgagtgctaaccactatttttccgctttttttgtcctttttctctcttgagacccagtctcacacggttgccaagattgctccattgcactccatccttggcaacgagtgaaactccaactcaaaaaaa

SEQ ID NO: 258211 - DNA, 107 bp, Homo sapiens
tgagctgggggctctgatcctagcttccttgctagctcaccgcatatccttgagaagagcccctctgctcctttgttttacctatctgtaaaatgaaggttctgtac

SEQ ID NO: 258212 - DNA, 423 bp, Homo sapiens
tggggcttagcagcctaagccgtgggtctgaaggctcagacaggttcagggcccagaggagctgactcaggcctgactcccccgggaatcagggaaaggccaccagctaagaccgccaggggtcagagtcaggatgaattgctcgatgtccccaggggcactgccaaagccactgtcattcccactattcttcctggggtctaggagcaagctccagtgccctagcctggcatgcaaagccgggcaaagccccatggctcatctgggagctcaccctgcatgctctctctgggacatttcctcttttcctgtggtgttggataccatctgtacaccagcagtccccaaacttcctccagaccgccctcctgagtccacctgacagtttacctgatgtctccactgggatgacccataatcttc

SEQ ID NO: 258213 - DNA, 457 bp, Homo sapiens
gtgaatgtctgggtgtgaataccagagatatttctagataaacataatcagaattttgcttagaaaagtgtttccctaaggaccctttcttgagacacagcttcttgaaaaaaaagataaatatctagttaaactcatttatcatcacaagttattatgaaatggcagcccactggtgaccttacagactcactgccttaagtcccagccaagggatcaacacaattgatgatttaataattaactattctttggttacaaatatctttgcaattaattttccagagtaggctgctctacaggtgattgctttcaaatccattaaatgggccaggcgcagtggctcatgcctgtaatcccagcactttgggaggccgaggcaggcagatcacctgaggtcaggagtttgagaccggcctggctaacatagtgaaaccccatctctacaaaaatacca

SEQ ID NO: 258214 - DNA, 259 bp, Homo sapiens
gtgagacatgtgagttctaaacatcaggctcatgaatttggactaaatttttgttatggaaacatggaaatcctaaattaattgatgccagaatataaattggttaagaacatcaagaaatcataacaactgagttattttgaagttggtgtaatgtggtcaatggaacgctggtgaatgatccttgaaacctggattgtattttagcactaagacagtatgcgtgtaatcacttgcaataaattcatttttttaggct

SEQ ID NO: 258215 - DNA, 311 bp, Homo sapiens
tattaaaaactgacatggttggctgggtgcaatggctcacacctggaattctggcactctgggaagctatggtgggaggattgcttgaggccaggagtcagagaccagctggggtaacatggtgagacctggtctctacaaaaataaatttttaaaaattagccaggcatggtggcacatgcttgtagtcctaagtacctgggaggttgaggtgggaggatcgctttagcccggaaggttgaggctgcagtgagctatgatcgcaccactgccctccaacctggctgacagagtgagactctgtcgcttaa

SEQ ID NO: 258216 - DNA, 691 bp, Homo sapiens
gaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcacatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaaga

SEQ ID NO: 258217 - DNA, 447 bp, Homo sapiens
cttttcttctgtcctgtgaaaacatccctgtgatttgaaaatgttctgataaacttgagtcagaaaaatcaacaggtagaatgtaaacttaacgatcttcatttgtaaacttaatgatctttgcagaaatctttgttttgttaattgaagtatccatgctctaggaacagtgtcaggcataacagcagtgctcaaaatatttgtcagatgaataaataaaggagtaagtgtgttgatcattaattaagtaggtccagagagtacaaggagctactggaaaagtagacttttccactgttttttcctcatgggctgaagatgtttgaagcatggagtgggggtagaagaatgggtttgggaaaaagtttgagaaaaagtgtaacttttagagaataatgtcaaaggagaacaagaggcttaaaaataaatactatagaattgaaagca

SEQ ID NO: 258218 - DNA, 329 bp, Homo sapiens
cagagatcagggacttccaggtgcctggcttgaactcatacccaccacatttctccctctggcaatggctgggcaatgtcagtgatcagaatatagaaggtggtcagtagctctcctccctgccaccccatcttccttccctcccagcctcctttccactctctgattccaagaacactggagctattgattggttaccctcttatttttctgagctgagaatggatttattactgcaataataatgatcatcatcatcctgggcatttgtgttaaatataccttccaaagcactgccacatttatttatttttttgagacagagtttc

SEQ ID NO: 258219 - DNA, 506 bp, Homo sapiens
tattttatgcaaaattgtcactatacccacttttacctctttatgctttttctctagttctgtgaacacacttatgatggctattttgaagtcttttctgttaaatctgacatgtggtctctctcacacaggcagtttataaggtctgctttttttctggtgcatgagtcataatttcttttttctctgcatgcctcataattttttgctagacactgacatttttgataatatagtatagcaaatccagttactgttcctttcttctacctccctctttcttggtgcttcttactgtttcttgcttattttttagtgactagccgaattattttagcaaagtctatttccccacttccccaacctccacaatgctaagccttggatgttgatccacagagaggtacatttttgggtacgcccacagtcaccctggacttacagtgatattctagctcttatcacaccaaggtgttaaactccactaactgttctactgttattta

SEQ ID NO: 258220 - DNA, 498 bp, Homo sapiens
ccttctgttccaggctgtgctaagtgcttttatgggctccaggtctggttgctcttctctagaccccggtcctcttctgcctgtcactcttctatggcactgagacatctttgtcttattttaggattgtttgtggatatgtgcgagcttatccagggccagagactgccctgttcgtttttgtgtcctccagggtcagggagagggttgaacctccataattgtttggcgaatggtcctgaagggacagaggtctgtttgcttgtacctttgtgtagtttataaatggaagattcagaaaagggcataagagttggtacatactgccacccaggccttcctcatttggcttggggtggctcacacagagttcacacaggcttccccacaggcaagctgtccttgaccactcctggctgcagaggaagaggcagatgtggaggccacaagccttctacacctccagccccagcctgttctgaaaagttggcggccgtg

SEQ ID NO: 258221 - DNA, 697 bp, Homo sapiens
ggagggagtgttgcattgaagcatgacagagctcctacagggaacctcaacaggtggaagaggaatggtgggcctaggtcaagtggagtggcaccgagtgagcagcttcttgtgtgtatacctggtttatgcttcaggagtgaaaaaagttcaccacccaatactgaggtttgagttctttaactaaactccaaagacaacaggtgttttatacatggattcccctgccccatttatgggtggggagagggcaaatggaacgttaggttaactagtttaaagagtcaaggcaatcccacctggatcccttcttaaaaaggaagcctgtgtccaagagtcccttctgctgagttaacaagaccccttcaacccgttctcatctttgggattgaggcgcctgcagaattacaagagaggatttgtcctcctcttctccagagagctaccttgattttccccacccctgccaagatagacattcatgaatgcagtcatccacacctccacaagtgcacacacaccagccatcctattttaaaacagacaaaagcaaaaccaacccaggatgtctctggacaccataaaccaaaatagtcgctggaaaaaacagtgatggtaggttccagatttaagattcataaaatggtaacatttccaaaaatatctctgatgaagacagtcatatgttagtacgttt

SEQ ID NO: 258222 - DNA, 541 bp, Homo sapiens
cagcttaaaaattagccagtatatactgaacatccactgtataaaaagcacattatggggtgctccagtaggtacagcagtgatcgagacagaatcatagccttcagggaagaggtatatgcaatgttctctccttccaaagattacctagatagagaactgttcataagaaatatcttggtactgtctacattactcttgagatataaaatatatattatttcttacgtctgaaatgagtcagttgtttctaaaacaatttgtattaaagtattcacattaaaaatttgtaaaatacagaaaagtagagagaaaaaatcatgaatttttaacatggtaatgattatatcagtttcgttcttggcgtttctttaacttgatgggatagctaatgttttttgtcattgcatagctttgtaaacttgtcctaaggattatataatttcagcatgagttagtttctaagtatgtcagaaatctagcttttttgtggtaattgttgttttacacaaaatgattaataaaagactctaaactaaac

SEQ ID NO: 258223 - DNA, 177 bp, Homo sapiens
tgtaggagacacattcccaggttttagggaagaaagtgtgatgagttgagatggatgcattgaccatctgtgatgcactcagcactgtaacatggtgtgtaagaccacagactgtgccatcggatggacctggattccaattccagctccactacagctctcactagtgcaaagtgc

SEQ ID NO: 258224 - DNA, 665 bp, Homo sapiens
gcaggctgtgtccttggtgggcagctttatttatttatttaatgtatttatttttgagacagaatctcgctcttgcccaggctgtgcagtggcatgatctcggctcgctgcaacctccgcctcacgggttcaagcggttctgctgcctctgcctcctgagtggctgggactacaggagtgcgccaccacgcctggttaattttcgtatttttggtggagaggggatttcaccatgttggccgggctggtcttgaactcgtggcctcgggtgatccgtccacctcggcctcccaaaagtgctgggattacaggtgtgagccacctcgcccagctacggcagctttaaatagcacatttgttatgatttcggaagggtaaactttacaatgacctgaggcgtggaaaaataacacgctctccctgccttcctatcaaaaaaggactttaaagctgtttggagcgagaaggggcagaggaaggctggctcagctgttgcctgaggaaggcagcgtcatgccagggaggagacagcaagcatcgctccctggctaccctgctgctgtcccttcctccccaccaagaggggccttcagccaggaaagatgaggatggaagacagctctccagctttggtgagtagagctgagcagcatatgtggggaggt

SEQ ID NO: 258225 - DNA, 342 bp, Homo sapiens
gcaaaattaagacaattttaccatcaggctgggtaataacaaatatgcagttatagatttgctttgttctgcccattatgctacagaaagtagttctgtgtttattatgtacctacttgaaagtatcttccttaaatgcttgtagaaggtggcttcatttaagtactacagaaataattatatatttaagtactacagaaaataattgtatgcaggccaggtgtggtggctcatgcctgtaattccagcactgtggttggctgcgtgggaagattacttgagcccaggagtttgagacccgcctgggcaacatggcgagactccatctttatttaaaataaa

SEQ ID NO: 258226 - DNA, 417 bp, Homo sapiens
gatatggtttcaaactgtacattgttactctcctttaggaaactatcatttattaagtttttggcataaagtcaaacatgaattttcgtaattacctaaaaaggctactaaaataactcttctttttcaatgactgtatctgtgtatgaaaagctggattttctttgtgtactttaacaaaaagcaacatacttacagggtttgttacagtgccttttcacaaactttgttttctcttcagcggtgaaagtcaaattttgtcaaaggctttttcaggatcttggagataatcatataatttttttctctagatttattaataggatatattatgccagtggatttcctactaatcctgcattcctggaattaatccctttttcatggagtatttatgtagtgttggcctttgtttgc

SEQ ID NO: 258227 - DNA, 457 bp, Homo sapiens
agaaggtcttaaaatcctcatcatcatcatagctatacttgcatatagtgcaagcacttttcacacatttaattcttaaagggcctcttgagaaaagctttataaactaaggcacagagataagtaatttgccccaaatcacacagcaaataagtggcagagtcagatctccaaacatgcagtctggctccaaattttatacccctaaacactatactatcctgactcctataaagcttctagagaaggaaggataggaagagggagaatctaaaagtcatcaggtttccaacagcaacactaaaagttataatgtaatggactaatcctttcaaaattataaaaagacattcctcttggcaataattttgtggatatgacatggaaagcacagacaacaaaagcaaaaatgaacaagtgggactacagcaaactaaaaagtttctgcacagcaaaa

SEQ ID NO: 258228 - DNA, 375 bp, Homo sapiens
cggccgcccccgcatccagcgcccgggccgccgcgctcaccagggcaccaccaacacttaagcctccatcttcaggcaagaaagtctgtgatatgaatgaagggatcataaaaggcacatggaatcaaagcttttggtcaactgccaacaaggtacagaggcccaacagcaatcatcgaatgaacttggaagtggatcctctcaccccagttgagccttctgatgactgcagccctggctgatgcttgactacaacttcatcagaaatcctcatgaagatccagcaccttccagttagcccatctgtgggttcttgaccctcagaaattctatgagataataaatatttgttgttttaagttgctaaactttggg

SEQ ID NO: 258229 - DNA, 485 bp, Homo sapiens
gaacactttagtatgtattttttaaaagataagggtttattttatttattaattaaaaaaatttacttagttaattcttttatagagatgcagtttttctctgttgcccaggctggtctcaaactcttggccccaagcagtcctctcacctcatcttcccaaagtgacgggggccactgtgcctggcccaaagattggggtttaaaaaaattctaatcattatcacacctaaaaagtaataataattccttagttacatcagatatccaaatgtcctcatttcttggttttcagagtgttttgagtcttcagacaaaactgtgaatatttactagtttcacctttcagcggaatgcctgttatttttaaatactctagtagtataaattataaatgtcagattttattcaaagtattattttatcctttggatttaaattaccttgagacccaaaaggatcatatttggatttattgctttctgt

SEQ ID NO: 258230 - DNA, 432 bp, Homo sapiens
catagatgcaccatagattcaaacttaatatatcaagaccagagctcatcctcatattaccttaaccagacgcccctcctgggttccctataccagtatctgataccatcacatccaccccagcatccaaatcagaaatctgagatttgtccctctccccaacaccccatatcaaatcactccccagatacctgatggcttgtgttcctgcccaagctattcttcacttctggaactttcctcctgttgtctcctctgctgggatgtccatcctcttacttctcatctgcttcaatatgtttgatcctggaagggtcagcatgggagggggagtgggcaggtcttccaggaagcctttctgagtcctggccactccgtgcctccatgagtggcttctggaccactcatcggtagttccatgatgcccctata

SEQ ID NO: 258231 - DNA, 337 bp, Homo sapiens
ctgggctggctctgtggctctctcctggggcaaagtgcaagagccttggccagccttggcctctccctgcctagttagaggtctttagctcagactgacgatctcgtattggtaattacgaccattcacagcagggagacgcagccagcgaagggcaagggcggtttagaggggagagactgcgatctgtagcagaagcgtgggataatagccttcctctcccctcctgaaccatttcacagagccccaactcactgccaggccggggcagagttcatggctgcagcgattgcaccactgctttccagcctgggtgacagagtgagactcagtcttg

SEQ ID NO: 258232 - DNA, 482 bp, Homo sapiens
ggaggggctgtcgatattattgttactgattaagtagattttgatccccagtgctggcagtgtttaaaaattacctgagagctttttcaaaaaaaagagatttccagctaccctcagacctgtcaatttagtttttttttaagagatgagccccacaaattcatttttaattgttttgtcagtgaaaaagcagaggtatctgagaaactacaaattgaaaagatgaaaaaaaaggataacatgtaaagttctactgattagctatgtgaactgctcatcacttatgcctaattataatgtgtcataaaagctatacatgaagatgatcaaaatgcatactttgaaaaaatttgatttcatctgtaaagacgtgtaagtcagatgacgtttaaggtgttataactggttccacagatgagtctattgctttatatttatactttctatgtgtagtctgcatggctgttcagttgttttgtttt

SEQ ID NO: 258233 - DNA, 2322 bp, Homo sapiens
cacctgcctttcaaaactggcccacctcctgctgcccaataacctgatgttgtcactctcatatttaaaacccataagtgctgccgggagcggtggctcacgcctgtaatcccagcactttgggaggccgaggcgggcggatcacaaggtcaagagatcgagaccatcctggccaacgtggtgaagcccagcctctactaaaaatacaaaaattagctgggcggggtggcacacacctgtagtcccagctacttggcaggctgaggcaggagaattgcttgaacccggaggcagaggttgcagtgagccgagattgcactactgcactccagactggtgacggagcgagacgctgtcaaaaaaacaaaacaaaacaaaaaacatatcaatgctgatgaaccaagtgcaaagccctgagcttggccaggcaacatagcctggaaacctgacttttaatccttactttgctctattcccccaacatacacacacttcatacaccacacctaaaagagacttcccacagttttccaaaaatgactcacatttatatttcctgtttttccctttgcccaccctgccctctctccctctgccttcatttttttaattaacctctggaactcaggtgctcctgctccaaggtttaggtcaaaagttacctcctccatgaagctttctctcattctcccacaatgtgtgaaagccccattctcagatttgcttagttgtgcatttgtatattctaccttgcactacagtcatttgtatatttatcttatggtttctgtgccttaggaaaggtacactgtcttaatcatctttgttcaatacagtgcctagcagagtgcctcaagtataatatgtgctcaataaataatagatgcatttttccatgcatattttctactatatcgaagtggaaaatatatccatgtgatatagtggaaaatatctcatgaagagagatacagtgaggaaaatatctcatgaagaccaaaaagcagaaatccaagttttttcttttcattactatcatcagtgattattaattttatgtgtcaacttggttgggcttagggatgctcagatagctggtaaaatattatttctggatgtgtctctcagggtgtttctgggggaaattagcatttgaatcagtagactaaataaagaaaatctgccctcacaaatgtgagccagcatcatccaatttattgacagtttagatacaacaataaggcagaagaaggtgaactctctttccttgagctgggacatccatcttctcctgctctgacattggagttcctagttcttgggacttcagattctcccctgaagtttctcaggccttttggcatcagactggaagttatgccattggctcccctggttctcagacctttggactcagactgaattataccactggctttcctggttctccagcttcaagatgacatattgtgagacttttcaacctccataattgcatgagccaatttccacaatatatctcctcttatgtatctatatatttcctattggttttgtttctctacagaatcctaatagatcatctaattgtttatctaacaagtattttcctccctagacgatatgttgggcactagggacacaaaaataaaaacacagacatctgcactcaataaacttacattcaatatcagagagattggcacagaatacaaataaaatgagatacatgcaaaataatatgaattgcaaaattacggcaattcaccaccaactaggtgtgtgaccgtgggaaaatcacactgtgagctaaatattagcaagtttaaaatgcaaaatcagaggcagtctatgaattggactttgctaatggcctcctttgctgatggatggcacattggtgttagaaagtgcttatttttgcaaaggtccattattgatgctttaattctaaggaaattatgtaggcagaaactaaagaaaggttaaaaaaacagcagctaaaattgatacttagacaataaaaaactaattataagtgatttatcagcaccactagataactacattggtgaaatttaaggccatgaaatgcaggacaagcctcgtaggaagcaaggtcccagtggatgagatgctgtcctctgggctcctaaccttccaccactagtattcaccatatctgattggaaatgtgtgcatgtgagtcggcctcccctctatgatgtgagtagggacctatttttgctcatctctgtatcctctacacacgatgcttggcacacagcaagtattcaataaatgtttatgaatgaagcaatc

SEQ ID NO: 258234 - DNA, 1166 bp, Homo sapiens
agctgtgggtcatgctgtaatcctaacagtttgggaggccaaggtgggtgcatcacctgaggtcaggagttcaagaccagcctggccaacatggtgaaaccctgtctctactaaaaatacaaaaattagctgggcttggtggcgggtgcctgtaatcccagctactcaggaggctgaggcaggagaattgctcgaacccgggaggtgaaggctacagtgagctgaggccgtgccactgtgctccagcctgggcaacagagcaagactccacttcaaaaaaaaggagaggagaggagaggagaggaaaggaaagaaagaaaagaaaaagaaacagggaagcttttagagtggaggaattaatctatattgtgatagacattacacaggtaaacatttgtcaaaactcatcaaactgtacacttaaatgggtgcattttatcataagtaaattatgcgcatgtaaagttgatttaaaacacacagtgtgtgtgtgtacttactagtctggtacattatgtttctacttctgtctgtttttttgtttttgttttttgagacagtctcgctctatcgcccaggctagagtgcagtggtgcaatcatagttcactgtaaccttgaactcctggctcatgatcctcctacttaagcctcccaagttgctgggactacaggtgtgtacaatcgcactgggctaattaaaaaaaaaactcaagcaatcctcccgcctcagcctcccaaagtgctgggattataggcatgagccacacctggcctctctgtattttctagtagcttgcgaataattgtttgttacccgctctcttttttccctttatcccctgcgccaaagtgaattaagcctgtcacctggaatttctaactattaaggccaactccatcatctcaacccttgccacagagttgtttgtttgtttccattttacaggggaatcttagagaaggcttttgcagaatgggaggtgtcaggagaaagccccagaagggggtaaggagggtaaggggtggtaggtatcttccagggagatatgcctggaagttcaaagagaagcattgagacccttatggtttgctaaggaagagctagttgggcctggcactaggaaagggcccaggctttgttttgtaagccagttctctcactac

SEQ ID NO: 258235 - DNA, 955 bp, Homo sapiens
acgctcacctcgcaatcaaagtgctaggattacaggcatagccaccacgccagctgatattaatatgaaggaatgctgtcttgtgtttgggtgcttttaaaggaatttctttcctttcccttggctggctgggtccagccatctccggccagcaaccctgtcagtgttccaccctgtcccaggccctgtgatatttattgtggctaaaggcaatgagattgggtggaagagaagggtctgggccagggactggagaggtgggggtggagtgggcaagggcacaccctgtggcagggggtcctataattttgtgtaaatatctgtacagcgcgctgctctcggcgttctctgtccactgggtgtgcattgatttaaacttctccactgtggggaagctctgtgaaatcgtctgatggtctgtgtggaagaaaagaaaaatctgtctgccgcctatttcccattggtgtcaattgaataaatgtatgtgaacttcagcagtcaccagctctgtctgcttgcctgcactcccttgcccctgatggggctctcccagaagagcttagctccccaacagagggggagtgaggaaaggcccctgggcagcccaagcaggcagagaggggtttgagcttagaggatgcaaggggcactttggtcttggccttcagctgttaatgaggccgaatctctgggaagcctgtggcctctccagcactttcattttcgttctagtcctaagaaggttgttgcctggagttttgcctggggttgtgtttccactgcacctgaggattctcatgtccttctagtttggatgttggcatggcctgggcagatctgggtgctaagggttcatgaacactctacccactaagtacaatttaaggtgaatatatctggtgatgtgtactctgtatgcctctgtttctgagtgaagggcttttatggaacttat

SEQ ID NO: 258236 - DNA, 5145 bp, Homo sapiens
gaattccggcccttggtcagaggtcccagagggggcccaggcgacttcctctcaaaggacatgagtagtcagacctgccttccatttttttctgcccttaccttggggggatgaagaactctattttgaggattctgtgaaaagggttgcaacccaactctgttctatttctttgcaggagcctgggtgagttctttctccctatcctgggcctctgtagctccatctgtggaatgggagagttggattaacaccaggctatcccgtagattggaggctgctgttagatgaaactgcaaagtgttctcagtaccctttcctaaatggcctagaatatggctacacttatacatcagttctgaggtaggtgttactagcctcatttttacaaaggcagaaacaaagcgcaaagaaccttgcccaaggtgacagatagggtaagtagtgaaggcaggattggaaccccaggagcctgacttaaggtcgctgctcttaactactatgcagaccaggaaactgaggctccgaagcggggaagtcacctaatgagggtcacacagccttgctacagcggaggcagctgggattccggcctcgcacgcccgagctttagccactgtgcggcgctgtcggggcagcagcccaggcatccgctcagttcctgctcacgtccagcgcccatctccccttccgtgccccagaggctgaaatgggcccaatctgtgttgaagctgcttgtttctgggtcctggagggaggccgggggagaaagaggtctaataggatgggcaggaacccggctagcgagaaacaaggcacagggccaaccttagttgcacaagacttttgagagatgaaggcaacacttggtggaggtcagggttcactgagggggtgtcgggcagggggcggaggaggtcctgccgcctgtcggtggggcccagaaccctgggagccaggaaggtggggggtgtccagtcctcagggcaactggggccagggagaggggagggagaaattaagcggattcccagacccatgaacagacatccagacaaatgccgtttccacagagactcacggagagtgagatagtcacagagactgagacaaacggatgccgagatccagagggtcggagaacaggcaaactcggagcagtagaccggcccgcgccccgggaacgcggccacagcggccggcgctttgcccggcctctccgcgcggagaggggtggcgggcccgacagcggagggaggagagggcgccgccgcaatctcacctctcccaggcccaaggctgcgggcgccaagttcgctcctggtgatcactcgaatgcgtctcccctcgggctggaagccgtgcgggctcgggtgggcgccggcgggccgcgctggggcggcgtgggtcccggcgtctcagcctcgcgctcccactgcgcttcggcccggtggcccgggcgccgccttggggagaggacgggtggggaccgccgccacttccctggctgcggctggcgcccgagtgagccttaacatccaggggctgagcgttctgaaggcggcggcttcagggagcacagggtgcaggagcggcggcgaagacaagggcccgcctccggccactcgagcccagctcccgccgcggcggcggtttgttcccgccgggtccctcagcggaggcgctacgcccgcccctgtcgcctcgccccaccccgcccagggagctccgccctagcccgcagctcttccgccttaggcagccgctaggcgggagggacaatcccccaccaccaaccactgccaccccgaggggactaggggctgaggcccgcccaggtaagggaaagcctcagctccttccgttgcgccccagcggcgggtcccagctcggattcccggggtagtggcgggggccgccggcgggtcgtgccctggaaggtgagcgcggccgagctgggccgccagggggcgctgcggagccgggggacacccctccctgcctgcctcagtcccccgccccctccccgcccgcgcgcaaaacgcactcgccccagaggcagcgcggccgagcccgagccgctgccggagcggagccggagagtggcggcggcggcggcagcggcaccatgaccctgggcagctgctgctgcgagatcatgtcctccgagagctccccggccgcgctgtccgaggccgacgcagacatagacgtggtgggcggcggcagcggcgggggggagctcccagctcgctccgggccccgcgccccccgggacgtgctcccccacggccacgagcctcccgcggaggaagccgaggcagacttagccgaggacgaggaggagtctggtggctgctcggacggcgagccccgcgctctggcgtcccggggggcggcggccgcagcggggagcccggggccaggcgccgcggcggcccgcggcgcagcggggcccgggccgggaccgccgtcggggggcgcggcgacgcggagcccgctggtgaagccgccctactcgtacatcgcgctcatcaccatggccatcctgcagagccccaagaagcggctgacgttgagcgagatctgcgagttcatcagcggccgcttcccctactaccgggagaagttccccgcctggcagaacagcatccgccacaacctctctctcaacgactgcttcgtcaagatcccccgcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacccgcacgccttcgctttcgccgcggcagccgccgccgctccttgccagctgtcggtacccccaggccgcgccgccgcgcctccacccggacctccgacggcctcggtgttcgcaggcgcgggatcggccccagctcctgcgcctgcctcaggctcgggcccgggcccgggccccgcaggcctgcccgccttcctgggcgcggagctgggctgcgccaaagccttctacccggcgtccctgagtcctcccgcagccggcaccgcggcgggtctgcccaccgcacttctgcgccagggcctcaagacggacgcgggcggtggtgcaggcggcgggggcgccggggcagggcagaggccttccttctctatagaccacatcatgggccacggtggcggcggggcagcacccccgggcgccggcgagggctctccgggaccgccattcgcggcagccgcgggtcctgggggccaagcccaggtcttggccatgctgactgctccggccctggctcccgttgctggccacattcgcctctcgcatcccggggacgcgctgctgtcctcagggtcccggtttgccagcaaagtcgccggccttagtggctgccacttctgaccgcagcaggcccagggccggttaggtccgcactcctcagcctctcccgggagttcctgcggtcccagcggaactcagggagtctatttatgaagtctccagaccttgggccggcacgcgtgacacggcacttcaggctccacgcacagaatctcgcagatagttgggactaagcgggctctatcgctcagggcgacaggcccggggctacgcgaagaagtcgcaggccaagattctttacagtttgagaaataaaagcaggggggtgggggcttcgtttttttccctgcctctgcgcctctcggggaacacattccgggagagatgcctggccaggctccacggatcccgccagaaacaccaacagagggtctccctttctgcctttcccctctcacttcttccccaacgttgagaccctgcttgtccaatattataatttaaagacatctattatctgctttgtgcttaaaagaaaaattcaaccttttttttttttttttttttgctgttctccaaggaagttcgtttcctctgaagcctaaaccagtgtctacgcaggcggagctgaacggagaggtgaagcagggggtctttatattccctgcagaaaccctggatcccactccaccggaattcctttctcttttgtgtttgggtgcttttaaaggaatttctttcctttcccttggctggctgggtccagccatctccggccagcaaccctgtcagtgttccaccctgtcccaggccctgtgatatttattgtggctaaaggcaatgagattgggtggaagagaagggtctgggccagggactggagaggtgggggtggagtgggcaagggcacaccctgtggcagggggtcctataattttgtgtaaatatctgtacagcgcgctgctctcggcgttctctgtccactgggtgtgcattgatttaaacttctccactgtggggaagctctgtgaaatcgtctgatggtctgtgtggaagaaaagaaaaatctgtctgccgcctatttcccattggtgtcaattgaataaatgtatgtgaacttcagcagtcaccagctctgtctgcttgcctgcactcccttgcccctgatggggctctcccagaagagcttagctccccaacagagggggagtgaggaaaggcccctgggcagcccaagcaggcagagaggggtttgagcttagaggatgcaaggggcactttggtcttggccttcagctgttaatgaggccgaatctctgggaagcctgtggcctctccagcactttcattttcgttctagtcctaagaaggttgttgcctggagttttgcctggggttgtgtttccactgcacctgaggattctcatgtccttctagtttggatgttggcatggcctgggcagatctgggtgctaagggttcatgaacactctacccactaagtacaatttaaggtgaatatatctggtgatgtgtactctgtatgcctctgtttctgagtgaagggcttttatggaacttat

SEQ ID NO: 258237 - DNA, 1543 bp, Homo sapiens
ccagctgatgctgatggtgatctagagatccccggcgtcacagcttctccggccgcacagcctctcccgggagttcctgcggtcccagcggaactcagggagtctatttatgaagtctccagaccttgggccggcacgcgtgacacggcacttcaggctccacgcacagaatctcgcagatagttgggactaagcgggctctatcgctcagggcgacaggcccggggctacgcgaagaagtcgcaggccaagattctttacagtttgagaaataaaagcaggggggtgggggcttcgtttttttccctgcctctgcgcctctcggggaacacattccgggagagatgcctggccaggctccacggatcccgccagaaacaccaacagagggtctccctttctgcctttcccctctcacttcttccccaacgttgagaccctgcttgtccaatattataatttaaagacatctattatctgctttgtgcttaaaagaaaaattcaaccttttttttttttttttttttgctgttctccaaggaagttcgtttcctctgaagcctaaaccagtgtctacgcaggcggagctgaacggagaggtgaagcagggggtctttatattccctgcagaaaccctggatcccactccaccggaattcctttctcttttgtgtttgggtgcttttaaaggaatttctttcctttcccttggctggctgggtccagccatctccggccagcaaccctgtcagtgttccaccctgtcccaggccctgtgatatttattgtggctaaaggcaatgagattgggtggaagagaagggtctgggccagggactggagaggtgggggtggagtgggcaagggcacaccctgtggcagggggtcctataattttgtgtaaatatctgtacagcgcgctgctctcggcgttctctgtccactgggtgtgcattgatttaaacttctccactgtggggaagctctgtgaaatcgtctgatggtctgtgtggaagaaaagaaaaatctgtctgccgcctatttcccattggtgtcaattgaataaatgtatgtgaacttcagcagtcaccagctctgtctgcttgcctgcactcccttgcccctgatggggctctcccagaagagcttagctccccaacagagggggagtgaggaaaggcccctgggcagcccaagcaggcagagaggggtttgagcttagaggatgcaaggggcactttggtcttggccttcagctgttaatgaggccgaatctctgggaagcctgtggcctctccagcactttcattttcgttctagtcctaagaaggttgttgcctggagttttgcctggggttgtgtttccactgcacctgaggattctcatgtccttctagtttggatgttggcatggcctgggcagatctgggtgctaagggttcatgaacactctacccactaagtacaatttaaggtgaatatatctggtgatgtgtactctgtatgcctctgtttctgagtgaagggcttttatggaacttat

SEQ ID NO: 258238 - DNA, 714 bp, Homo sapiens
cttgggaagtccacaatgtcaattaccctctagtggtattgactcaagtcttttgtcaataaatctttaccaataaatgtgagtctcactagctggtcagggctgagtcgcaactgtttacaggactctgctggagtctgtaagcggctcggagacactcagctggactggcaaagcagaatatctgagtgtcagtgtacttcattcatctgtcactgggtcagaggtctgcaaaggacagaccccctgcagctggtgtccccgtgtgaggagtgctaccacaccccgactcattccttacatgtagactattttctttactggttcagcaaaagccaggaaaaacaactctgtagcaagcagaatgttattcgactatatattgtttaatttattgtaaatactggtgaacagtggtcaataaatagttttatattccttcaaaaagaaagaaagagcttgcagggtgtgcataggttgtctgcaaacgctgtgccattctgtatcaggggcttgagcacctgtgatgttagtatcttcaagggagggtcctggagccagtcccccacgtatactgcggactgactgtatttggattttgacagaaggctgagaaacccagaatgtcagagacaacctcccagccgtagaaagccgagttaatatcaggagaagccagtggttaaattcacagtctttttacacacaagagca

SEQ ID NO: 258239 - DNA, 572 bp, Homo sapiens
aactttgtaaatcttgttctttccaccctactggcaaagacattgggtggtaaatttctgttctctcctagaacatcagtcataggccagtttgcctctgttgctactgctattcttttcaaaacaaggggaaatttctagaaagtgtaactactaagttataaatatgtatattttagatgaatttattcagtgttatacactcacacatgccattctgcagattattcattgattgtatgttaggaattagtgatacaatattgaaagagttatctaagacttaggagtatcaagaaaatttcagttaaatgtgggctgataacagcctcctaggatcactacgcttggttcgttcaggtattgaaagtaaaggtcatttctagggtactctttttagtctactaaaaatagaaaatttgtctgttttgagtttcaaaacataaagaaggcaaagaccagttcttaatttgcaaagttagtgtgtttttcctttaatacttcttttggcaaattcagctggttctaggaaatgcagaaggctggcaatggtaagatgataaaaaatcagg

SEQ ID NO: 258240 - DNA, 533 bp, Homo sapiens
ccacagcctctgagtagatcctgacccagcattccatggcagtatcctttggaaagaaactttcaccaaacctgatgggaacctctcctcaaggactgctaagtcaggaaatggggtatgcagggtctggaagttggaagctggccgcatcccccaaatgagcaggtccaagacacttattcatacatcaggaaaaccagggtccagagatggagagaaatccaaggcttggagccacttggatggtcacccagggccatcagcatctactagccaggaggaggctgggacattcgggaggcaatggagagaaggaaatagaaggaagagggctggggctcccagcagtctaattacagggtcccaaggcccagcagtctttcagggagaaaaatcggtcggacttggacaaatcagctgcacagtgttaaccttccagagactgaactctctccccatttccaggaatctaatctttgatgtatctttgaataactttaaaaaaaataaatcctgaataatcttaaaaaaat

SEQ ID NO: 258241 - DNA, 355 bp, Homo sapiens
atgagcatgatagaaaaaaattattctctatttcctaggagagaaatccaaggcttggagccacttggatggtcacccagggccatcagcatctactagccaggaggaggctgggacattcgggaggcaatggagagaaggaaatagaaggaagagggctggggctcccagcagtctaattacagggtcccaaggcccagcagtctttcagggagaaaaatcggtcggacttggacaaatcagctgcacagtgttaaccttccagagactgaactctctccccatttccaggaatctaatctttgatgtatctttgaataactttaaaaaaaataaatcctgaataatcttaaaa

SEQ ID NO: 258242 - DNA, 621 bp, Homo sapiens
aaagcccgtctgtactgaaaatacagaagtagcttggcatggtaatgcacacatgtagtcccagctacacggcaggctgaggtgggaggatcacttgaacccaggaggcagagattgtagtgacccaagatcgtgtcactggactccagccttggtgatagagaaaaactctgtctcaaaaaaaattaaaaattaaaaaaaaagaaaaaagaaaaggaaaaaattggggtataagtggacccatgcagtttaaccctgtgttgttcaagtgttagctgcaaagcaagcacctctgtagccaccatcaaaacatctatattataggaattacctataaaaagtaaataggaaattatacatgagagcgctttgtcataatcagttattcacagctaagacatttttcaaaacaactttcctcattttttattaatggataatactataaacattttgcatggctaaaatctatatgtaaagtacctaaaacaatagaagccatattggtaagcccttaataaatgtaatatattactatcatttaatacattaatggtattttgataacaattacacttttcaaagatatttaactctgattctatattctatgtaaaaaaa

SEQ ID NO: 258243 - DNA, 419 bp, Homo sapiens
gaggacaaagtcagcacagggccagagccagagcaaagctagaaactcctaacagactttattacaggaactttgttttactgcaaatcacaattgatcttaagggtcatagttttcatgcaacagaacatatagtgatgaccattgggatctttagaaaatcaacataatcttatgagaaattccaactacaaatgataaatgtagaaaatttaatcaatcatctacaccaagcggagctagtatatactggggagtatataatttaattccttccgtttcttccacaaattaatgctttgtaattaaatgaacctcagaatgtttatacacagaaccagaagtcattcatttaagggcagtactattgtcaacattttcttctaatttctactgcggcctttcttattttttatttt

SEQ ID NO: 258244 - DNA, 1159 bp, Homo sapiens
tgtataaaagtttctatttcggcatactttacttttacttaactaaaatttcaaataaaatgtatccacttttatgatctcaacaagatcggtcattcctatagcggagttgaaaactttcaacttattcacaattatcaaaagaatggagcagcccccacagagacttccagcaatgagttgtaaaatgcagtctgcattaagtagcttccttacaatcatcccgatggtaaaagtgtcaaatttcgcaaacgcctggacaaggaagtgaaatgatcatctaataacgcagttgactcatctgtcaaataagcgagtgggccagggtccctgagctcactaccctcagattctaactccagcttcacatcattaggcgtaagcagccaattgggccgtctgggagccgtgcatcctgggagttatagtttccggctccctccttcagattacaagctccacagagccgcgggaggacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatt

SEQ ID NO: 258245 - DNA, 410 bp, Homo sapiens
gttttttttcacaaattaaagaactgaagcccctctacacaattattaattttagaaatgcacccatgtccacattatacacaatagagagtgaagaaggaatagaagtcatagaaatctcatgtttaaaatatggtagtactaacgggaaagtggatcccactccctcttgcttcattcaaaaaagcagtgttaaaaagtttgatttataagttttatcatatgaagaaaacagtattacggatagccacatgcaagagaataaagttggaccccctcctttacaccatacacattaactcataatggatcaaagacttaaatgtaagcccatttttttaaatcccaactcttagaagaatacataggagtttttcatgaccttaagttaagcaccctttttagatacc

SEQ ID NO: 258246 - DNA, 486 bp, Homo sapiens
tgcatatagctagccaggtatcccagcatcatttactgaatggggagttctttcctcatcgcttacttttgccaactttgtcaaagaccagttgcctgtaggcgtgtggctttatttctgggttctctattcggttccattggtctatgtatctgtttttgcactagaatcatgctgttttggttactgtagcctcatattgtagaaaacgaaatactgcatgtttgctgtcacttataagtgtatattcatggagatacagttggcaataatagacaatggggactcctaaaaagggggcaagggttgtaaaactaactattaggtagcttgctcagtaaccagctgatgtgatcaatcataccccaaaccttggcattgcccatattcttatataacaaaactgtacatataccctatgaatctaaaataaaagttgaaattatttttaaaaagtaataaaggttctagctctgtagcaaatag

SEQ ID NO: 258247 - DNA, 706 bp, Homo sapiens
gtcatttccttaacttgttttaatgaaacttcttattttgagataactgtagattcacatccaagtgtaagaaagagatcccatggacactttacttagttttgccaaatgttaacttccttcaaatctatagtacaatatcgcaaccagcatactgacactgaggcaactcaccaatcttacccaggtttcccagttttcagtttagttttgaatacgccagatttaaaatgctggagatattcatgggaaaatatgttaaggagcaggtggatatgcaagtctgatactcagaagggtcaggggaaagatgcaaatgtagcgaacattaccatatgtgggatgcaatgccttaaagaatgtgttcatgactacagaagtacctagcagacacaatcctggggacagaccagtttatcatgcagagtaacaatattggtagtgcactcgctgtgcactggccctcttctaagcccctgacatgcattaactagcttaagagtggtgaagggcacaggttctagagttagctggcctggttcctgccctggctccaatcacttaccagctttgggagttttagagcaagtcagcccctgggtgcttcagttacttgcctgtaaaacagggctagtaagtgttcttagcctatacagaattattttgaagattaaatgagatgccacatgctaaaacaatgactggc

SEQ ID NO: 258248 - DNA, 433 bp, Homo sapiens
gctgatcacaaggtattagttatgaaacaacctgttggcactcttctgtctccattattacccaactttttaatgctataagtccaattttgtggatcaactacagcctaccaagacaaaagttgtttggagagagagcaaaggaaaaactgagcaggaaataagtaagccaacagtcatcacctaatgcaactgcacagaaaggctgaaaaatattttaagtcatttcaaaatgtttgtagatatcaaagagacaaaccatctgggtgaaatattccattactcttctttcttttgtaggggcattaatattgaactggaaaaatctcacccctgccgaagttaacatactttgtacttaacacctcattcaaaactctcaagcaagttaagttctaattagtaataaaacttacaagtgcatagccattaa

SEQ ID NO: 258249 - DNA, 293 bp, Homo sapiens
cagagtctctgctgggcaacaggattccagaagtagatttaggaacccaactatttattgatgggattcccactgtaggttaccctagaggggttcttaattgtttaaaagtaaatgacaattcttaaattccatgtcactaattttatcatttattacattctttaaagagtgagggaaggggcccaggcacagtggctcatgcctgtgtggcagagtgggtttctcctgttcacaagttcccacgggaaaggccaatctgcctggccccatgtatccattaaacaaactaa

SEQ ID NO: 258250 - DNA, 366 bp, Homo sapiens
aaaaaacaatcatctgaatagatacagaaaaagcatttgacaaaatccaacatctgttcctgataaaaactcccagcatgaggaaaagaagggaacttccttaagattttgaagagcatttaccaaaaaacctataattaacatgatgatggtgggaaactgaatgacttccccctaagatcagggaaaatgcaagaatgtctgctttattgcttctagccaacattgtatgggagagtctagccagattggaaaagaagaaataaaattatctatgtaatttttaaaatcctatttgatttagcaaggttgtaggttataaaatgtaaaagaaaaaataaattgtaactctccagataagcaatt

SEQ ID NO: 258251 - DNA, 461 bp, Homo sapiens
tttatgttgaggaacttccactgaaatgcttgtatccttggatgcctcccttagctctcctgctgtaagcttttcctttcagaacagacaaatagccttgtctctattgtcaaaaagtaggctcttttattgttgtcatacttttcttggtttgagaatactggggctgggcaagatggctcaatgcctataatcgcagcactttgggaggccgcagtgggcagatcacctcagatcaggagttcaggaccagcctgaccaaaatggtgaaaccccgcctctactaaaaatacaaaaattagccaggcatggtgccgggtgcctgtagtcccagctactcagaaggctgaggcaggagaatcgcttgaacccgggaggcgcaggttgcagtgaaccaagactgcgccactgcactccagcctgggcgacaagagtggaactccatctcaaaaataaaaata

SEQ ID NO: 258252 - DNA, 393 bp, Homo sapiens
  misc_feature (346)..(346): n is a, c, g, or t
  misc_feature (350)..(350): n is a, c, g, or t
gttttggccccagtcctgagggttgtgtgtgttaggggacccacctcacgttcgccgaggagttcctgcatattcttgcaccatcccgggtgctgttgctggggctctctttatttgcacgcgcgcttctagcttttttcctgacattttccactccacgctcgttctttctcccttgcattttgttgcttgcctgagactctttgctctcgcccttgcccaggctggggtaattctgtgtgcgcgcgtgtctcccccgcaccaaccttttttgcacactcgaagctgaatattttcttttttagagaatttacccgcacctcctgcggggttcctaagcactctntctnctccctccccccaatataaaaatatagacttttaaaaaaaaaa

SEQ ID NO: 258253 - DNA, 677 bp, Homo sapiens
tagagaagtggaaagaaccctgggcctgcaacccagcagttgtacaccgtggtttcctagaggaactcatgcacatgtgtcctggagacctgcaagaggacagcaccatggagatgaccagcaactaataccacccaaaggtccaccaacaggagaatggataccccagcaggggtgcatgcatgcaacggaacacaccacgtactggtgagagtgaatcaatgtcggtcacacgcatcaacgccgatgaggctgagactcgtaatatcaaatttagaattgcaagtagcagaaggatcaaagttatatttgtaataaagcttaaacacaagcaaatcgagcactgtattgtttaggcacacattcacatttggtaaagacataaagcaaagcaagggaacgagacaaaaatgaaatcccagagtaatcaggtggtcaggtcttggggggtggcgtggagttggggaagggcatcagagtggatctcacctcagctccgactgctttgggaagttctagttctgacatggagtggtgggttcacagctgtttgattgcttgttatgctttataacaatataaactgcatatgttcagttgaaatatttcataataaaggttttttaaaaaagaacattgggctcatctttcccatcagatacaggcatttttgtttt

SEQ ID NO: 258254 - DNA, 402 bp, Homo sapiens
ctgtcctttcccctttactgtctgacaagctactactcaacctttagatcatagctcaagcatcaccacctctatcatttcttcctttctccaggctcatttaggtgttttttcccgtttggtcccactgcatcttatgctatgcagatctccattatctttttttttttttttttggaaatgaagtttggtaccgtggtccaggcgggcctcaaattcttgagcctcagtttcctaagcgggggcttgtcccacagcacggggcttaaatggctgcaattaagtccatgaagtactcattgggaggctaaggtagtccctgggaaagttgggagagagcagggaccttatcttaccattggatttaatatatcccatggcaaaggacccacggggtggcac

SEQ ID NO: 258255 - DNA, 480 bp, Homo sapiens
ctgtcctttcccctttactgtctgacaagctactactcaacctttagatcatagctcaagcatcaccacctctatcatttcttcctttctccaggctcatttaggtgttttttcccgtttggtcccactgcatcttatgctatgcagatctccattatctttttttttttttttttttgcatgtctgtctcatactgtactctgggtaccagaatgataacttttaattgtttacagtgtctggcacatagggatgctaataaatggtgaatatcagtattatcatttttagttcaacaaatagttattgagtacttgctccatacagggactttatatgcattacttttcactctcacaacaagtttgcaaagtagatattctctttattttatagatgaggaaactggagtttaaagagattaaaagacttacctaagctaaacaactaatatgtacagtactatacttatattggca

SEQ ID NO: 258256 - DNA, 359 bp, Homo sapiens
tttaaacatccatcagtgcccatgaaaaaaatttttaaaaataatctgaatctcacttgtttattgcctacaatatcaatcaatggcttaggtatctctccgtgttctattacttctcaccgctcttaattcatgaggtcaaacagaatcttaaaacatcattaaaaaatttcctccctttccatgtctcaaggtatctgtaaatggacaatttgggtgtgctgaaatcaaatgactgaccaaggcccataactgtgatcacaggtaaaatgtttttctgctttgccaaaaatccgagtttcctttgctctctctgtcaagctgaaagagccctcccagacccaggggccaggtggaga

SEQ ID NO: 258257 - DNA, 376 bp, Homo sapiens
gtgttcaagtttcatgtggcaaatgaggaaaatagcctttgactttggataaaaaccaaactaatgttttcttaatgttgaaagtcaatacatttgagcatttgacactccatagattctgatttggaatgttttttatctgtgacaccaaaactacaatgcttcctttactttctacataaataagagcaggagaaatcctactgcattattaatctgaaagcacaaggacagctagtcagaaaattctaaactgaagagagtttaaaaaaaacattgtattttactatttttttttactaatgattgagtgaaatagttcattagggagataggcaatatttaaataaagaatggagtttgtcgttgattttcg

SEQ ID NO: 258258 - DNA, 572 bp, Homo sapiens
aggagggggaggaggaggaagaagaaggaggaggaggaggagaaaaaagtgggaagatcaactgtacctgattttaagacttactgtcatcgctgtattagtcaagacaatgtggtatttgcagaggatagagaaatacatcaatggaacagaattaagaacccaggaatacacccacacaagtatagccaactgatttttaaacattcaatgaaggatattcttttcaacaaatgaaccccacaacttacacaaaaattaacttaaaatgggtcatagatgtaaaggcaaaacataaagctagaagacttccagaagaaaacaggtgaaatctaggactaggtgaaaaggtcttagacatgacaccaaaaacaatccatcaaggaaaaatctacaactggactttatcaagattaaaacttttaatttgcaagccacatatctgacaaataactcacatctcagatatgtaaaaaactctcaatttcaacctgagaaagctgaaaaaagaaactctcaaaaacccaaaagatcaacatacattttactaaagagatatttcatgtactcgc

SEQ ID NO: 258259 - DNA, 406 bp, Homo sapiens
caggcagttagggacacagcagtgaactaaataggcaacaatccttgcctttgtggcactgacattgcagagggggcaggcagacaatgaatgagcagacaggtaatagcagtggtatattagatggtggtatgtgatggagaaaaacgtagcaagaaaggggctgagggagtacaggatggctgtcagagaaggcccgtggagaagatgacatttaaagcatatgatagagccagaactgcatcgatctggggcaggagcatttcgtgcccagggtacagaaggcacacaggccctgtggggaagctgtcaggtgtattctaggagcttcagggaggctgctggtgtggctggagcccggtgaaatgggcagagtgtgctgaggatgaggtcagagaggagcaaa

SEQ ID NO: 258260 - DNA, 495 bp, Homo sapiens
ttacttttcagagtgtttaagtgcttgtttttgtttgtttgtttgtttgttttttgtagtttgttcagttttagtggtgaacagtgcattagatagattctagttggcttatttcatcttagcaatcatcgaaaacttagatattttatctttaaaattacaaaccaatatggactactacaaacatctattagagcgtcgctacctttaaatatgattccctagattgggtgtgatacttctgtattttagaaagttcccctgccccaataaatctaaaatgtaaggttaaaaaccctcatttcttctttatttgcctagttcagccaatttgactctcagttggattttgagaatctcagtgatgtttcagtttggaggtcagttcagaatagctttttattctaattttaatacctctattatcctgataaaagtgttgttgatgaaataattttgaatatctcaataaaaatctcaagtgcctaccaaata

SEQ ID NO: 258261 - DNA, 541 bp, Homo sapiens
agaaaccgcctcaggcctcagagggaggcatcctggagcccaccttgccggggaagcttgagcaattcgctcacaactgcccatttttgcccatttttgcccattttaaaggtggggaaaccgaggtctggaaccccacagggagagagttgctcaggcctctctgagagccccatgttttctgattctccagtttaacacagggcagcctagaagaagggaaggcagtaaataagaaaaggcagaaacggtcattaaaatgttaatttgtgtttttctctcccccttttcccctcttccctaccttccctccagggtcaaaaagagctaagggatttttttaaggacagaaaatggaagacagccttcagcaggatgaaaaggactatggagtcaggccgcctaggtaggaatcctggctcaaccaactggctctgagacactgggcaagtggttttaaactccctctgcctcagtttcctcatttgtaacatgggggtgataataatacctccttcgtagggatcttggtggggggtgt

SEQ ID NO: 258262 - DNA, 311 bp, Homo sapiens
tgatccaactgctgaaacaaagccaaattgctgccgaggcccagcaggcagaggctggaagctttctgagacgtttcaggcgctgccaccttccgggaagaaagagaagcattgtgttcaatggggaaaagatcctgaaattatgtaagggaacaccaaataggacccagcaagtaaaaaagtgaaggaaactacttccaatatggcaaagttgatcctcaaattcagaactattctttcccagccctgcagacaagttcaacatcttaagcatgggaaaacaaaccagataaacaaaaccacaaaacatc

SEQ ID NO: 258263 - DNA, 1358 bp, Homo sapiens
gtctgagtggggtgaacatggcagtcccagtaggaacagcttgggttggtcatggctgttaatttttttctctatttctgaaccctacaacccacagatatgtgttcatcgcattatttcctttctgggtggcaggaatcaatataaagctgctgtggtgattttaccatcctcccttttattattacttttgtacctttttatgccttgctatgttatcaacccttttactgctctgagttaaagacagcacataaatagttatgcaaataaaatgaaagcgtatattgtttaatttacctttagttatttcagagagaaaaaaaatacatgtaacctaaatgttccaacgtatttcttaacagttgtatctgctttgggaaaagaatctctgtaaattttcttttaaaatttttatttccttaactttgtgtgggtacatagtaggtagtaggtgtacatatttatgggatacatgagatgttctgatacaggcatgcaatatgaaataaacacatcatgaagaaggggttatccatcccttgagcatttatctttcaaatctcagtaaattgtaaagcatttctgttcagtaggtagacatcagccacatttgctattttaagtttacatttacctaaattgaatacaatgaaaattcttcgtctctgtagcctagtggttttcgaccagaggtgattttgtccccaaggggatatctggcagtgtctggagacatatttagttgtcattaccagggaagatgtgccactagtatctagtggggggctcagggatgcagctcaacatgctgcatggtagtgttaccatgcacagaacagccaccatcgcaaggaaccattggcccaatatgtcaacagtggcgagagtgagaaactgcactagccacatttcacgtgctaagtgtcctatgtagctagaagctgtgatattgaacagcaccaacttagagcattctccactgtcagtgctgacatttggttctgtcaggcagtgtggtctcaggtgagagggaaaagataagaaggactggaagcagggaagtgatattctcatgaaaatacatttctttgaatgagaccacagattctagatttctttgccatagacggttccatcttaagtttctgaggttatgattgtcactgaagtcatactattagtaacagtactcagctgtttgtggagtactccctgatcgacaaatggtttgtcatgaattgtctcatttaatttttgtaaaactgtaaaacaaagaagctctctatattccaggtgagaaaagtggggtgatttatttttctgttataacaatgtgtagcatgaacccttgcaat

SEQ ID NO: 258264 - DNA, 509 bp, Homo sapiens
tggacataattgcttaggttagcacttgaacactttgttttaaattttttttattgctgccaaatagtcatttaataaatacccaattgtttatgtaaagagttttagaggagctataagtggtatccatgggtgaaagaatgaatccatttatttgaaatgtatagggtaattaatggctccagttttgaaatagatatattacctggtgttgattgtttttttaactttgaatagatgtcagattgtatgataacacattcccagtctgattatgttgaagctaagagtatcagaacatattgtaacatagtctatttattgattcaccggcctcggcctcccaaagtgctaggattacaggcatgaaccaccgcgcctggccacggtgctaagaatttagtagtgaataattcagtggcaaatcctcgggagtgttttgcaaataagagtgacactttttgtccttcacttctaggaaacgtggtgactatgttgagaaaaggggg

SEQ ID NO: 258265 - DNA, 877 bp, Homo sapiens
ctgcaggctgctggcttctgcggctgcggggtcggggtcgcggccagggccaagccgcagcgagttcacaggcggaacccctgcaggcggcgccccctacgcgaggtcacccctgggaaggagcgcagcccacccggcccctccgcatccgagcaggacgcccgtctcctctccctgaggatttcaggtctccctgtcccaggaggcttgtgccaagatggcatcagctggagacacccaggcaggcccacgggatgcagcagatcagaacttcgactatatgttcaaactgctactgataggcaacagcagtgtgggcaagacttccttcctgttccgatacgcggacgactccttcactcccgccttcgtcagtactgtgggcatcgatttcaaggtcaagaccgtctaccgccatgacaagaggatcaagctgcagatctgggacacagcgggccaggagcgctaccgcaccatcaccacggcctactaccggggagccatgggcttcctgctcatgtatgacatcgccaatcaggaatcctttgccgctgtgcaggactgggccacgcaaatcaagacctactcctgggacaacgcccaggtcatcctggtggggaacaagtgtgacctggaggacgaacgtgttgtgcctgctgaggatggccggaggctcgccgacgaccttggtttcgagttctttgaagccagtgccaaggagaacatcaatgtgaagcaggtcttcgagcgcctggtggatgtcatctgcgagaagatgaacgagtccctggaacccagctccagctcaggcagcaacgggaaaggcccggccgtgggggatgctccagccccccagcccagcagctgcagctgctag

SEQ ID NO: 258266 - DNA, 450 bp, Homo sapiens
gatggccggaggctcgccgacgaccttggttagtgcccagcctgggccacaggccctggtctcccagaaccaaaccctcatccccatcctctgattcagggtccaacccagtcactgatcctttgaggatctgcccaggaagatacccatgtgtatgccacatgtcccgtctaattgcaggggatccacgcgcaggaactcccactgccccactgcctatcccctgggaacccagcaaaaccatttctggaaattgatcctagagatatcctcacccatgtgggatatggtgtgtggagtgtagtagtagtattagtaggagtgaaacctacagatcccccccaggtgtctcacagttggagaaccaagtggacataaagtatattcacatggtggaatactatgcagccatggaaaaggatggggatgttctttatttttttatttttt

SEQ ID NO: 258267 - DNA, 262 bp, Homo sapiens
actctggaaaatattaatatgtttcaaatttctatacatgtataatagtgattgttttagacccaatgaactttaattgttgggtattcttgggtaacaatatttttagaactttgatacattttggtaaccatttgtaagatagttttattttatttacattcttatgagaactaattgaaatgagactggtgatacaagtcaactattgcgtcagagctaaccaatttgaagataaagaattgaggtggggttgaagtgg

SEQ ID NO: 258268 - DNA, 212 bp, Homo sapiens
tgttttctttatctttctgtttttccactaaaagctccgtttttccatcttcccattactctccctttcctgtgtacactcctgaagacaggcatcctcataaggtgttctgaattaactttagggtgttctccaggtactttgcatctttttatatttcttgtaaattgttaatttctaagctccatgattaaagagaattcaccactctc

SEQ ID NO: 258269 - DNA, 219 bp, Homo sapiens
agccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctac

SEQ ID NO: 258270 - DNA, 440 bp, Homo sapiens
tcgtctcaaaaaaaaaagtgtcagacttttagttatcaccacttacccctctttttctcttccttggtgtccatccctcctgtagcattggcgtggttcactcccagctggacacccaccttggaccaaggtccctcaacgttgtctcgtgggctcagcttagtgcttgctgcatagcaggactcagaatatccaaacacgtttcatgtggggtgactctggcagatctgaaatgacagacggccccttggcggggcagccgcaagtcccagtaatgccagcactagctccgagagggaaaattcattcctcaaccgcttcctggagacccttctcctatgaacagagagttgtgactgcctgcagctgattaggcccttttgatcctaaatagcagggattagcactcatggtccttcatggttaaagaggtcacagct

SEQ ID NO: 258271 - DNA, 722 bp, Homo sapiens
gacagagggagaagtgtgtgcatcttctgggagaggaggagcggagcctggcggggaaagctgtttgtggactcccctcctaacccacctccccctcctttcctctttctcaggacgtgcagcccctcatccactaactcactcatcatttagcttttactatgtcctcttccccttctaggaccaggtcaaggaaatatgtaattatcctctaaaaggcactcattcattcgttcaacctaggatgcacgtaacactggccaccagggcccgtgctacatgatggacacacagaacggagaaagacagatcctattcccccagagctcaatctagtcacagaggttaaagctaccattagttactttttggcagcaaagtgcctggagcctaggagatactcaactttcagaagctgtgtgaaattgtttttgaaaataggcaggattcaaaccatgaataaatgaatgaatgaatattgtcagctgggctgactccattctgtttcagggcccctgcccctcagggactattaagccacagttttagtaggcgcctagccctggtgatttacactgcatgagaaactgtagatttggggagaagttgccagttgcttttaacagagaaagctgataaaaggtgctcctggaaacagtggaaggtcaggtgagatcaagctcaatttgggctacagggaacatttagaaggttataaaaag

SEQ ID NO: 258272 - DNA, 463 bp, Homo sapiens
cagaggcctgaaggtccctgctatgcagccgtggccacagctcacagcaccagtgctgtggagcatccacacctttgatggcaatgcagagtgatagcaggttccataggtgtgacaaaacagcattaaagctcagtattttgcatatttttagcatttaaaaatatttttgctttagtgtgaggaaagtaaggatgggcaaagaggcgatcaaaatagctattgctatgacattttagaaaacaaagttggggccgtatttctttaaaaagataagcctctaaaaatgcttggcaaaaaaactatagtgttaaaataggccagtgatattaatgagaaaatgaaagtatatatcaggaataaagtgatattgcataggagtattgtatttttatgaattttgtgccagttgtttacatgtactatatatgttaaataaaaaaatcatgaaaaatgagggaaa

SEQ ID NO: 258273 - DNA, 445 bp, Homo sapiens
ggaagggcccctccaggaatcctgagagaaaaatctctacccagcagcagatgtgggcttgtgacagctccattgttggtcgggtggaggggggttgcggaggagaggcccactctgtgtggccaggattcaggggccccgagagaggccactggctctcaccccaatcctctctgcctgttgaaatacaaatagcctgcacttgagtgctcacctgtgctactccattccacgccggacaattgcgagagggaggctccatgaggttcccattttatggatgaacaaatggaggctcagagaggtttagaaacatcccaagattggtaaagaggtgaatccagggctgaactcgttctgatgtgtttcacggctgatattttaacaatgaaaccttactgtcttcattacgataagtctaataaatggcatttgtctactcaca

SEQ ID NO: 258274 - DNA, 769 bp, Homo sapiens
  misc_feature (737)..(738): n is a, c, g, or t
atgggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattacaaaggaacaaaaacaaaaaaaaaaaaaaaaacggggggttttattgggggggggaaaaagggttataaagggcgggtatttgttttggccttttttgaagggggaatggggccanngagggtatatgaagagtattggggaaaggaa

SEQ ID NO: 258275 - DNA, 797 bp, Homo sapiens
  misc_feature (765)..(766): n is a, c, g, or t
atgggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattacaaaggaacaaaaacaaaaaaaaaaaaaaaaaaaaaagcaacaaaaaagaaaaaaaacctcggggggttttattgggggggggaaaaagggttataaagggcgggtatttgttttggccttttttgaagggggaatggggccanngagggtatatgaagagtattggggaaaggaa

SEQ ID NO: 258276 - DNA, 621 bp, Homo sapiens
atgggctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaatta

SEQ ID NO: 258277 - DNA, 377 bp, Homo sapiens
tggaaagtgcagagaagtatacacaggaagaaaaattcccaacccccagaggcaaaccagctgaaaccacgcaaccccagtcaccccaatgcaccgcgaggctgctgcctcctgtcagggtcagatgagcctcgaggctcaggaaagtcagaggatgccatctgcatggtggtaaattacagaggtgatgaggcaaggtgggtgtggggctgttcttaaaacggggcagcaggaaggccccaaggagatggatttgggctgggacgggaagagagagctggccatgctggggtgggtgggtgttcaaatggtggaaacagcagacgcaaaggccctgccgttggaaccagcttgtggaataaactttcagaaacaga

SEQ ID NO: 258278 - DNA, 462 bp, Homo sapiens
ggggcctgtgctggtcacgtaggaggggaagctggagccaggcgtgcagaggcgtgtctaggataccagggcaaggctggcccaaggacctggggcgggcaagatggtggagatgtggttttcaagaaggcagggaggctgcagatttgttaatgtctttctctttggtctaggagatatcgcactatgggaatgtggggaagggggttggtcggagcctggggctctgtctgtcattactctggcatttcaactcctcattcatggcctaattccccctccctgggagtaggggcaccaataatactgtggcctggcctgtgtccccttttctcctccttcctccctctgctctctagacttagggcctctagccgcaagcacccctcagtactcctcactaccaccctcaccctaacatctctgccccagctttattcacccctactcattctccttggt

SEQ ID NO: 258279 - DNA, 425 bp, Homo sapiens
agagagagggtgggagaggaatttttgtcgttaccttttccgccctgcatggaagagcagaactccaacaagagtccagcccactctcaagcctcaattctagagtttctgactctatgtgccaagaagacctgatcatcagtactagaaaatataaatagtaaatatacagtcatgtcaattatctaaagaatatatgtagagtatgagaactgaaaagctcatgacaaatgttttgtcatagatgatttctgccgtgtgatcaaattcattcatccactcatccgttcatcgttacttaacaaacattgaatgagtgaccactgtgtgccaatcactgtactaggcattataaatgttgtagaatattctgaaacaaataaacagttaaagctcaatgtacatttgtaatttaataaagtaga

SEQ ID NO: 258280 - DNA, 679 bp, Homo sapiens
ctggatcttgtgaggactactttgccactctttggaaatgcctagttgatccttggtttagacataaccttggttaaggtgtattggtttggtaagtcattgaaaaagaacctttgttttaaaagaaagaatttgaacaaaatatttataaaagataggccctcaggtaaaataggctttcttctttcccagagctgtccatgccgagtccaggcatagagaaggctttctttgccctgttcattaaagagcttcacaatgatgtcagtcatctcaccaagaaacaaactaagttgaaaagcccacctatttaactaagttggtctgttacagtaggcaggcagacatgggcaaggcaggagatcacccccaacctccaccaaggaatgtcagacaaccattaggtgatggtcaggtggttgttaaactgtctctctcaaataatatttggttgcagccggcgccaggaaaaggcaatctcccagtagatagaaaaaccctgaaactgatgatcagtaggttcctgataagatctcaggaggtgggcgagtaggctcaagcatgcacactaagaggcaaaaatggtagagtttaactggtatatgaccttcctctaggaacagtcaactggtaaggaaaaaaagatgcctcaagtaagcatgcacataacttcagtaaa

SEQ ID NO: 258281 - DNA, 429 bp, Homo sapiens
tccctcctatctcctacccctgtaaggaagttggtccctgttctgaggtctagtggtactagaagctggctctcacttcccttcttaaatctccaaagagctcaagaggctgaaagagggaaaagacaaaatgccctctagaaaaggaaagccttacttcaccccttgagtgtcctccaagtatagtggaaaataggaaaaatgaatctctggtatgggaagtctctagacttgaatctccttttaaaataagtacagcccctcagagtcatagcaggaaggcccctcagctctgcccccaaagaaaaataatggtaaagggagtggaagtgaaggtgggggcggggcagctgctctcataagagccctttgtggtggctgcctctgaaaggaggttttgctagacaaggtggaacttctcaaggtgac

SEQ ID NO: 258282 - DNA, 206 bp, Homo sapiens
tcctcttgttatttgagaaaataaaatatttgaatatgctttttacatacagttaaggtaccaatgagaaatcattcttattcatcaaagttcatttgtttcactaggcaacaattagcaatcctattttgtaacgacatctacttgaaagtaaaaatacaaactgcattcattaaaaaaaataacaaacatgcaacttacacttt

SEQ ID NO: 258283 - DNA, 510 bp, Homo sapiens
ttttttgagtttggcgaggacagacagcgaccgattgtttttatttccataatttttaagataccttaactggactctgtaggcaaagggagtaggtagtcaaaaacattttttaacaagcttaaatatctatcatgactcatagaagaatttccttatttcttcaccatctctacctgccttccaaaatgctgactcactgtcagctactttgacttaaatttccttagtgaaggctgatgaacccttgaatgggagacctatgtactttcttccacccagttcattcgtagcactttgttaatagaaccctcgaaaccttctgcctgatgtaacaatatgtgtatggttctatctagtgattaataaagaacagtgtagtaaaagtgtagagactttggaaccagacagatcttcatcggaatcccggttctgtctctacacttgctctgtgctgtggttaagttgtttcacatctctaaaatgggaataaaatgggaataaaaatat

SEQ ID NO: 258284 - DNA, 562 bp, Homo sapiens
cttctcagtttctaatctagcattgtccgatagaaatatattgagagccacaaatgcctgctacatatgtaattttaaaacttttcttgtggccactaaatgtggccactaaaaagttttttacagtgtgaaattaatatcaataacatattttatttaacccaatgaggtaggcaaaataatgaaagatgtccaagatccctgaaatgtgaatatattccttacatggcaaagggactttgcagatgtgattaaggctaaggggcttgagaagaatagagtgtcaagaatcatacaggtgggtccaatctatggtcagggagatgcgaggatggagaagggcgagagaagagatactgttggctttgaagatggagcaaggagccactagccaaggagtgtgggaaacctctagaagctgaaaaaggcaagggaacgaattctcacctaaggcctccaaaaggaatgcaaccctcccaaaaccttgattttgcccaatgagacctgagtcagacttttgaactacagaaatgtaagataataaatgtgttgttttaagcca

SEQ ID NO: 258285 - DNA, 1080 bp, Homo sapiens
cggtgcccagctcagtattggcaactaggagagtagtgagattgaacttggccttgaggaacagctgcctctagagttggatcagacaagggtgctgagagccgggactcacaaccaaaggagaaatgagcaatccgcggtctttggaagaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggagaacaaagggaccccggtgaaacagtaggtggagatgagattgtgatggtcatcaaagacagcccacaaaccatcccaacatacacagatgccttgcacgtttattccacggtagagggatacatcgcctaccgacatgatcagaaaggctcatgctttatccagaccctggtggatgtgttcacgaagaggaaaggacatatcttggaacttctgacagaggtgacccggcggatggcagaagcagagctggttcaagaaggaaaagcaaggaaaacgaaccctgaaatccaaagcaccctccggaaacggctgtatctgcagtagaagtagaaagaccaggaggagctttccttccagcattctttctgtctcacagaaatttagaggcagctcttacctctccccaagatcttctgttcccaaggccaaatggcacccagtttcttttccatcacacccttcatgcaggtcctcctgtccttattagagcaagccagccaaaacttagcacaaggcatggtggcaacattaacatcacctccctcaggct

SEQ ID NO: 258286 - DNA, 400 bp, Homo sapiens
gagattcgaaagcaccatgaaaagagaccccactgccgaggtattggggtgcctactccaggcctgtttgggggaaaggtactaggttggaagtgtaggctatggggacccagctgagtctggttcttcctctcactccagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggaggtggggacagatccaagagcacagagtctgtgg

SEQ ID NO: 258287 - DNA, 389 bp, Homo sapiens
tcttcattcttaatagccccagtgtagaaacaatccaaatgtccattaacagtggaaaggatgaattaataatggtacatccttctaatataataacaggtcgggcaaggtggcttgcgtctgtaatcccaacactttggaaggttgaggcaggcagatcacctgaggtcaggagtttgagaccagcttggacaacatggtgaaaccccatctctactcaaaatacaaaaattagccaagtgcggtggtgggctcctgtaatcccagctacttaactacttgggaggctgaggcaggagaatcgcttgaaccccagaagcggaggttgcagtgagctgaaatggtgccactgcactccagcctgggcgacagagcaagatcccatctca

SEQ ID NO: 258288 - DNA, 494 bp, Homo sapiens
catttgagataattagtgttactatccctattttgcagattcggaaactgaggcacagagaaattaagtaatttgagattgcctatggaggagacaacgagtgtttgccaccattcagttctgtatatcttatgccgcctagcacagttcttgcccatagtaggtacccagtaacccagagaattttgaatggaatcagaacgtagactagcatgaagctacattaccgtggatggtggctcttgggaggagaggcccgtatggagtcactgcaaaccccaacaggattcccgaagccactgggttcataaagatgtcctttctgcttctgacttagagcagtcatccaatttaaggaaatgtggaaaaagaagtagaaaaatctttaaaggttttatttcacaacactgctgtattaagttgagggataaaaattggattactagttatttttggttatttagtatcattattaaaatggtgttatttatcta

SEQ ID NO: 258289 - DNA, 650 bp, Homo sapiens
ccaggaagggtgtccagtgttgtggggcagagttacaagacgagccctgtggctttgggtgacagatgggtattctgagcagggcacagcatgctgggtgcagagtttgttcgatgtggggctgtatgttttctacagcatgtgttttctcgcatgtgtgtcttgtgctgcacctatgacctgtttatgaactgttttctgcagagctggcatgctgtatgtgttgcggagggtgccaggatgcagtgtatgtgcccttttggagggggcggttgtgggcctttgagtcagaaggcgtcacgtctgggtcccatttctgtggccctgctgaggtgtggtccagtggtgaagagggcgatggatgggtttgcgtgtctgtgatgagcgcgttgcatggggctgcgcgtctagaactcagatcccaaagatcatgagaggagcgaggaaccccggggtatgtctcaggggcctgtgggtcagttggcactggtgtgaggggctcgaggtggaatgcgccagttgtgtttatgggatcatgggcagccaagcgaggggaaggttgtgtgtttgcaacattctccacaggattcttttgtgacgttgtttgtaggagcctgtctgggctgctgagctgggaggcaaactggtca

SEQ ID NO: 258290 - DNA, 316 bp, Homo sapiens
agccatgggttggccttaggtttcctgtttctagaccctattcttctgcctcaagtttggttccttgattgtaacacctgccataccaatgatatcctgaggtacaggctactatacagcaatgaagtaactgcattccttcaaagccttttcgaagagaacaggcttctaagcccatgtagacattgtcaactcagagtatgtgatacaaaggagggaaaagctgctgaaggctggaccatcatcaatattccaagtataaccttatgtccatctgtgaagtctaataatgaaataaagtgtatctatattgttt

SEQ ID NO: 258291 - DNA, 817 bp, Homo sapiens
tgaacatcagactccaagttcttcagcttttggactgtttgacttacaccagtgatttgccaggggtcttgggccttcagccacagactgaaggctgtactgtcagcttccctacttttgagattttgggacacgtactggcttcctggctcctcagcttgcagacggcctatcatggtacttcaccttgtgatcatgaccactggtatagcttgcctggtggtggacttggaggataccattgcatcagggcatttctccacatgatagctcctgcctgctggacaggtcctctcttgactatgtgtattctccagagaagcagataatggctcttgtaggaatgaggcttttaggcacttggctgatgtggatctcatctccttgcacctgggctgtgctgcacagaattcccacaaagactttcacagaaaagaaatacctcaggttgtactgctggcatatttggtttcccatcaaggtccttaacatttataaaattggattaaaataaactaacgaattaaatatgaatatgaaaataaacagctgttttcatggaaattgcattgatgtggattcttctgaaggcatgtccctaaagaacctgccaacaaattctgtaaaggcagaatgaacattctggaaaatttatgtccttgtgtagaaggctagaaaaaaaaaagaagaaaaaagaaactctcagcctgaaggcctacgtaaaacacaaagcacttctgaaatctttttggggggccaaaatcacaccaagcaatgcctgtggaagtgaatgtaatcaagtattgccctaccatct

SEQ ID NO: 258292 - DNA, 514 bp, Homo sapiens
tgaacatcagactccaagttcttcagcttttggactgtttgacttacaccagtgatttgccaggggtcttgggccttcagccacagactgaaggctgtactgtcagcttccctacttttgagattttgggacacgtactggcttcctggctcctcagcttgcagacggcctatcatggtacttcaccttgtgatcatgaccactggtatagcttgcctggtggtggacttggaggataccattgcatcagggcatttctccacatgatagctcctgcctgctggacaggtcctctcttgactatgtgtattctccagagaagcaggcagaatgaacattctggaaaatttatgtccttgtgtagaaggctagaaaaaaaaaagaagaaaaaagaaactctcagcctgaaggcctacgtaaaacacaaagcacttctgaaatctttttggggggccaaaatcacaccaagcaatgcctgtggaagtgaatgtaatcaagtattgccctaccatct

SEQ ID NO: 258293 - DNA, 481 bp, Homo sapiens
tcagcatttggtctttgtcttccaggaccactggtatagcttgcctggtggtggacttggaggataccattgcatcagggcatttctccacatgatagctcctgcctgctggacaggtcctctcttgactatgtgtattctccagagaagcagcatttataaaattggattaaaataaactaacgaattaaatatgaatatgaaaataaacagctgttttcatggaaattgcattgatgtggattcttctgaaggcatgtccctaaagaacctgccaacaaattctgtaaaggcagaatgaacattctggaaaatttatgtccttgtgtagaaggctagaaaaaaaaaagaagaaaaaagaaactctcagcctgaaggcctacgtaaaacacaaagcacttctgaaatctttttggggggccaaaatcacaccaagcaatgcctgtggaagtgaatgtaatcaagtattgccctaccatct

SEQ ID NO: 258294 - DNA, 742 bp, Homo sapiens
cttctgcatgagaatttgaccttcatttaaatttcacgctgggtttccctgttaaggttggctatgctgctaaccagtgttgtttatggtaacacaaatcccatgattaacactggaaggcctatacataagctgtatatatttgataggaagtcacacttggggtcttcctgagtgtggtgaatttgtaactgccatggcctttgtgaagaccctggaaattatgcctacgttgctgtcaccccaacagataatggctcttgtaggaatgaggcttttaggcacttggctgatgtggatctcatctccttgcacctgggctgtgctgcacagaattcccacaaagactttcacagaaaagaaatacctcaggttgtactgctggcatatttggtttcccatcaaggtccttaacatttataaaattggattaaaataaactaacgaattaaatatgaatatgaaaataaacagctgttttcatggaaattgcattgatgtggattcttctgaaggcatgtccctaaagaacctgccaacaaattctgtaaaggcagaatgaacattctggaaaatttatgtccttgtgtagaaggctagaaaaaaaaaagaagaaaaaagaaactctcagcctgaaggcctacgtaaaacacaaagcacttctgaaatctttttggggggccaaaatcacaccaagcaatgcctgtggaagtgaatgtaatcaagtattgccctaccatct

SEQ ID NO: 258295 - DNA, 879 bp, Homo sapiens
taggtttaggaaatttataaatgttcccattcaccttcagactaagttgttaaacctaattggggatcacaagtctacatggttcaatcgaagagctctccagtttgctgaatgttttggaggatgaataccattaagaaaataaagaaagatgccacaaaacgtgtgagaatttcagcacttaaaaataaataaccctacagaagaagctgattatactcttagtcctccctcttgctcttcacatgagatttggttcttctttttagcagttcaatgtattgacagaagtaaaaaagtcaaccaagtcctgttagtcttattcctaagtgtcccctacatttgtttatttccaagattacagccactgccatatttcagattatcactacttattgcctgagatgccatcttcgtcttacctcaccttcctcaaattcattggtgtatctgcctgcagagtcatttttctaaaatttagttatgtcactctcttgcttaaaacctttcaatttctctctattgccaataggataaagtctaaattcattagcattttataatctggcctgatcatctttccagcttcatcagctgcccatttccctacacattacaatgtctacttgggtcatcttagaaagtgggttatccttttcatgctgttatacatgggatactgctatggtttggatatttgattcctccaaacctcatgttgacatttggtccctaatgttggaggtggggcctaatgggagatgtttgggtcatggggttgtctccctcatgaatggcttgctactgtcctcttggtaatgagtgagttaccactctcacagtttcctagagcctggcatctcatttgttaaaatgagc

SEQ ID NO: 258296 - DNA, 932 bp, Homo sapiens
taggtttaggaaatttataaatgttcccattcaccttcagactatttaatggaaaccagtaagaataagtaagcagcttactttgtgtggttttctaagttgttaaacctaattggggatcacaagtctacatggttcaatcgaagagctctccagtttgctgaatgttttggaggatgaataccattaagaaaataaagaaagatgccacaaaacgtgtgagaatttcagcacttaaaaataaataaccctacagaagaagctgattatactcttagtcctccctcttgctcttcacatgagatttggttcttctttttagcagttcaatgtattgacagaagtaaaaaagtcaaccaagtcctgttagtcttattcctaagtgtcccctacatttgtttatttccaagattacagccactgccatatttcagattatcactacttattgcctgagatgccatcttcgtcttacctcaccttcctcaaattcattggtgtatctgcctgcagagtcatttttctaaaatttagttatgtcactctcttgcttaaaacctttcaatttctctctattgccaataggataaagtctaaattcattagcattttataatctggcctgatcatctttccagcttcatcagctgcccatttccctacacattacaatgtctacttgggtcatcttagaaagtgggttatccttttcatgctgttatacatgggatactgctatggtttggatatttgattcctccaaacctcatgttgacatttggtccctaatgttggaggtggggcctaatgggagatgtttgggtcatggggttgtctccctcatgaatggcttgctactgtcctcttggtaatgagtgagttaccactctcacagtttcctagagcctggcatctcatttgttaaaatgagc

SEQ ID NO: 258297 - DNA, 543 bp, Homo sapiens
agtgtggcatatttttcaattcaaagatttaagtattttaaattgttacataattattcatatatttcaatatgataattttgctgcataatgtgaaattttaaactatggctacatttcagctcctgatatcctataggtgaatttaaatctcattaaactaaataatagtcattcaaaaatatttttgaaatttttaattttaaccgattttaagcaaagtaggaatctttttcaagaaatgcaagttaattaaagagaagttgttgaactcattcttcatctctactgtaaagatgagaataagcagacttaatggacaacatgaagaatttgtgttaactgtgaaagaataatagctgaattgatctttacatattgaaaaagctgattctctaaatatcttaaaaagattaaattgtctatttggagttgttgggtgtttttcctttaaatcagggaaatggtccagatgatttataaattctttccctgcttcttcttcatatgtctttgataaataaacactgtcaagttatctgg

SEQ ID NO: 258298 - DNA, 481 bp, Homo sapiens
ccacttcctctctcaccatgggatctctgcataggccagctccccttttcttcccaccgtgaatagaagcagcctgagaccctcaccaggtgcagatgcccaatcgttaactttccagccatctgaattgtaagccaaataaatcgctttaaaaaaaatgatttcaatagtttttggggaacaggtggtttttggttccatagataagttctttagcggtgatttctgagattttggtgcacgtgtcacccaaacagtatacactgtatgcaatgtgtagtcttttattcttcacctccttcccacccttcctcccgagtccccaaagtccattattatcattcttatgcatttgcatcctcagagcttagcacccactcataagtgagaacatatgatatttggttttccattcctgagttacttcacttagaataattaaacttctttttctttataaattacccagccctgagtatat

SEQ ID NO: 258299 - DNA, 251 bp, Homo sapiens
ctttatagcagccaatggccagctctcctgcctttaatgtactgtggatattaagaaaaagcatgattttctccatgccttaaaagacctcagtctattagaagaggcagaagtggaaacagataagttacacagatcagtaagtaaacaatcagaacatgtcactatgcttaaattatatttttatagccatacctgttctataaatcagaagttagcaaactacagccttgcaggccaaacccactctt

SEQ ID NO: 258300 - DNA, 685 bp, Homo sapiens
ggaaggaaggaaggaaggaaggaaggaagaaagaaagcaggatgtacagcagggtagctgtagttaataatatgtatttcactaatgcatagagctcccctgcccccacattagcaggtaaagctgaaaaaggtagataaaagcataagtgacctcagaagactgaaattgcatctgaagtctatctccctatgatcctcagcagcacaggtatttttttttctacacctgattcttgggaaaatgatggaataaaaagagtctttttccatctccctagctctgcttttatactcttctgccccctcccatgtcaacaccccataaagatctctgacaaagtttcgctttctgttctacaatccacccctacctccaataaacacacctgttaagggtcccatcacatcagtgcctgtggggatgggcaaatggattctaatgtatatggtattcaaggaggaggtggctggctcattcaaatcaaggtgtcttcccactgtaaatagtccttcaaaatggatctcatggggaaacttcatactggaggatatcccaaacatgcaatgttcaacatatgtatggagtgcttatgtgccaggtgctatggccaagtgccaggtggaagggtgaatgggacacagatcccacactcgcagacctcacagcctcatgcggagagtta

SEQ ID NO: 258301 - DNA, 703 bp, Homo sapiens
gctggccttctctctcactaccatcagtgccttagattcaggaagacctggaaccaaattcccactccaccgttacctacagtgggcctttgggcaaatcagtgaaccttcctgatttagtatcctcagaagttcaaagtgagacaatgtaaaaatgtccatggggtagagctgctgggatgacaaaagggaaaaaaatacataaagcttctgacatgcagtaagcattccatgtgtattgattcctggacaatgcacactgttatttatttatttatttatttttacctgagaattggattagattagtgctggagttctcagtgggcaggaaagagaaggagatggtatcctcttaaagaaaacctcaaatttctctctctacctcactccatccccgccttggcctggatctcctccttttttctgtcccttcttcctacttgcctttttgcctcttgagattccagttgctgttcctttctctgctttcccatctccatttggtcttcagtctttgaggtctgggttctaccctgaccactccactacaactgctctgccaagatccgcaaggatgtcatgcttacaaaagccaagtcctttcttcatattgatctcattacttttctatggtagatcactctatttctaaagcacatttctcgccttggcttttacatagctttcatggtttatttct

SEQ ID NO: 258302 - DNA, 460 bp, Homo sapiens
ataaaaacagtcaacacttgccccaccctactcccagcatatgcacacacacacgtgcacacacaatactcacttaacaaacatttaatttattgaacatttattatatgccaaagctggtataagacaccaaaagagtaagacagaaagtattcttccctggagctttgtctgactttccaagctttattaggcatcaaacaaaactgaagtgctttttaagattcaagtctcctacgtcgtctaaggcagagtaagtagccttcagtactatattttactctaatttttttttaacacaatggcagtactataagtatgaaactttggtataaatgtcagattctagattgtgctcctgctttctgcacactctaatatttttaaacatctcgaaaatacagagtggcagcaaaattacctgtaaaaacatactagctcaagagtttgacaggctcaa

SEQ ID NO: 258303 - DNA, 201 bp, Homo sapiens
aacctttccatgactgccaccctcacattcaagactgaactggtcagagaaatagacgagacacctcacgggaagccctatgtagttagtattccacttatatcttttttctcttcttctgtagtgatggaaattttagcagggcacacagccactcagctaaacactacactgcctcaccctcctagcagctaggagtgg

SEQ ID NO: 258304 - DNA, 124 bp, Homo sapiens
atataaacatatatataaaatatgtttttatatatgtttatacatatttatatattgtgtatgcttatatgtgtaatatatatgttttttctatatattttttttttgagacagagcctcgcat

SEQ ID NO: 258305 - DNA, 868 bp, Homo sapiens
tttatttccaaatgattgtcatatgctaagtcaagataaacctaaaaatgaaaggagctatttccatcataagaaattaactgactaaattacacataaatatgcaatgaatctggtgcttgatatcatacgcaaagagaagccgtgatgtgtcatgtctgcgtaatggaattcaaaattattcatacaattataggtttcaaagtggcatgaactcatcctattctaattacatctacaaaactttaaacatagttctgaaaggtataagataacccagccctgccacacacacacatcccgccccccaggaaccccggtttcactgggccgccagtgtaactcactcctggcacttcctcctccccaggctcccctctcaagtcctactggttgcccctaatttcctagacctctaatgccagggtccagagctcatgccttcaacagctcatcctcgtgctccccatggagtctcagctactcccaggctccatctgtgcggatgcccaacaaacctacatctccagcccaccctctggcccgaaccccagactccttctcacccaccactgccagcctgatgtcatgtacacccaaacttcacatgcccatgctgactttcccagccagctccgcctgcaccttccccagcatagttcaaagcaactccaagcgtgtggcaggatggcccggtggtctaaggtgctagacacaagcttccacttcccaaggcaactccaaacttccagtaacttgggccaacaccctggggctgcctgtgaccccacctttgtctctctccccaacgttagatctgccagctagtcctgtggattttatcttcacaatgcacacagaatttgat

SEQ ID NO: 258306 - DNA, 222 bp, Homo sapiens
acagatgaggaaatgccaagaaagctggtcaaggtgacacaaagggccggctgcacatctgtctcattccaaaagtcatgctgctaatgacctggagctccaaaatccaatccctcaaagaccctcaaggcccttgcggcctggcctccctaccccgcctgcatcccagcacaggcctgggcctgacacttcccactgcttcctccacctgaaacgctgcac

SEQ ID NO: 258307 - DNA, 678 bp, Homo sapiens
gcaaacagtaaatcatgattatttacatttgtatatactgtacaaacagtttctcaaaaataaagtacgcctgtcactttagggtaaacaactgacagtgtttgttgccaataataaaatttgagctttcaaacaaaaatcagaatttaaaaaaacttgtatctaccctataacctaagactcttctgatatatggtggtgatattaacaaatgtaatatttgcaggaagtgataacatttggaatatctacacaactaaaatacatgatgttacaaaatcatgcatgactaaaagatccatttgaaatgtaagaccaatgaaatgaattttactgtaacacagtataaaaacgtttcagatcctagacctgtaagaaagtgtcggcagggtgtggtggctcacgcagtaattccaacactttgggaggcagaggcgggcagatcacgaggtcaggagatcgagaccatcctggctaacggggtgaaaccccgtctctactgaaaatacaaaaaattagccgggcgtggtggcaggcgccagtagtcccagctactcaagaggctgaggcaggagaatggcatgaatccaggaggcggagtttacagtgagcccggactactccccgcgaacttcatctcgcgtgcccaataccagaactcctcttaagaagacccct

SEQ ID NO: 258308 - DNA, 3973 bp, Homo sapiens
  misc_feature (3170)..(3170): n is a, c, g, or t
ggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcangcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaa

SEQ ID NO: 258309 - DNA, 4084 bp, Homo sapiens
  misc_feature (3281)..(3281): n is a, c, g, or t
gtcctaccgagggaggagctacaggccaccgcgaccagcagagagcgaaggcaggagggaccagcctggcccagccccttcattttactgtcgggggtagtgaggaggaagaggaagaggcgaaggctggcggaggaggaggacaattatatagagtctgttgtgaaatttagatctatgttcaacaagaacaacagcaacaaactcagaagcactcctcgctaccgccggggagacccaggatacctaaactttactgagttggggccactcaagcctgaacagaaggatcagtggagccaacatagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcangcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaa

SEQ ID NO: 258310 - DNA, 489 bp, Homo sapiens
ggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaagggatatcattaggatctaattgcctacatgggagatagtgctttgaacacggtgaagtccaatataaatattaacaagtaacctgttctttgagaatgtgatgtactcagttcagtgcgttaattcttgacaactgcctggaaatacaaataaatacaaaacttaaagagaaaataaaatacaaatagttttaaaaactcaaagctacaaaa

SEQ ID NO: 258311 - DNA, 421 bp, Homo sapiens
aatactataataggtaaaaccccttgctagagaattagccaatctttttgatcaaattcatcagttttccagtttcttgtgggttttcttcaagtggtcttcattcataaatttttcctcccatgaaactacttctacagagtagctttttctctgagaataaagaaatctttttcttctgcattcgtggttgtctatatatatttctaaagttgttaggtaaggaagaatgttatttctgttctaagtgtgaggctagagcagacctttctctttggttgatttcctagacacaccatctcagcgtgttcagttcattcttggcaccgaggaagatgaagagcatgtgcctcatgagctgtttacagagctggatgagatctgtatgaaagagggatttttagggggaaacgggtccagt

SEQ ID NO: 258312 - DNA, 3839 bp, Homo sapiens
  misc_feature (3036)..(3036): n is a, c, g, or t
aatactataataggtaaaaccccttgctagagaattagccaatctttttgatcaaattcatcagttttccagtttcttgtgggttttcttcaagtggtcttcattcataaatttttcctcccatgaaactacttctacagagtagctttttctctgagaataaagaaatctttttcttctgcattcgtggttgtctatatatatttctaaagttgttaggtaaggaagaatgttatttctgttctaagtgtgaggctagagcagacctttctctttggttgatttcctagacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcangcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctctacaaaaa

SEQ ID NO: 258313 - DNA, 2286 bp, Homo sapiens
ggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagctttttaaaaacca

SEQ ID NO: 258314 - DNA, 433 bp, Homo sapiens
gagtcaaacttttgtaatgactgactgaaaaattagaatgtgatggggcctacagaggggcctcagctcctcaggtctgaagtatgcaaagaagcagcaaggcagctcctgacagcctttaaaccagttgttctaaaaacatttaactgagtatttggctgttttcctcaggaatctttttaatttttcccctcagctgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagctttttaaaaaccaat

SEQ ID NO: 258315 - DNA, 439 bp, Homo sapiens
tctcatattttatctaacctcctaggtcaaagatagtgagacaaaaaggaattgctcaaatactgagatgcatgtcaactcttccaacaacctccagaatttactgagcctgtaacacagcttttgtaatccttttctgtgaaatccagtactgtgtcagcttcgttagggtctaaagtgtacctttcataaaggacctcaagatttattttcctgagctttaaatgagtgaaaatgtgttttgttgaaacttcccaagaagtaactgcattttctatggaatcttccattgtttatgggcctgatgaaagcatttggcacttaatgattcccagactatttcaactttataaaaaatcaagaaaaagaaaaaaaaggtgaaaagtaaatgttttgaatgctaacaataaaatatgtggatttttaaaccttacaaaaa

SEQ ID NO: 258316 - DNA, 445 bp, Homo sapiens
tgatccactcgctcctcagcttaaagacatggtcaaagatagtgagacaaaaaggaattgctcaaatactgagatgcatgtcaactcttccaacaacctccagaatttactgagcctgtaacacagcttttgtaatccttttctgtgaaatccagtactgtgtcagcttcgttagggtctaaagtgtacctttcataaaggacctcaagatttattttcctgagctttaaatgagtgaaaatgtgttttgttgaaacttcccaagaagtaactgcattttctatggaatcttccattgtttatgggcctgatgaaagcatttggcacttaatgattcccagactatttcaactttataaaaaatcaagaaaaagaaaaaaaaggtgaaaagtaaatgttttgaatgctaacaataaaatatgtggatttttaaaccttacaaaaa

SEQ ID NO: 258317 - DNA, 474 bp, Homo sapiens
tgaaaaagtgctgctttggaaatggagaaatattcaaaagtatggtgtgatgttttcaagtggattgtgattatagtctcaatttgttgatcttgacctctagtggacaggtgcaggcttactctttgttcagtcttagtaaatgaggctcaagggaaccctgtgttcacatctgaatggatgaaatgtaggtatgggtactgtgtcctctcttgcagtatgggcacaaaactgtctttaaaaaagagacaagtagataactaacatgtcgatcttcctgtgatgaatggagaagcctgtggataatacacagaacaaatgaacgctggaaaacactaaggctcatgtaattagagataaccgtatctgtgaaactaactacaggtcctaagttatatgatactgaaagtcgtttatttattttttaatgaaaaacaatacccttgaataaaccttggatgaagttttatgaga

SEQ ID NO: 258318 - DNA, 641 bp, Homo sapiens
gcaaaaatccaagtgagggtacatacagcatttcactgtgtttttagtgttgatcttgcaaagcgaatgcttttatcaccgagttagctgcccttgatataatagagatgatttgttttggaacatagcacaagtgttacaggtttcttgcatatatcaccaacaaattctacacagtaacttcttgacataattttaacattctcgaaaagcgtgctcttttgtttaactctctcaacaacactgacccaggcaggataagcgatcctgtagattatcaagagtaggtgatttatttcatcatggtcaaaacatatacaaaatctgccttcaaacccatctgttcctagaggtagagatagatacatatttatacaaaatagagatatgtatttatacaaaaatagaagggagccatgggattttgaggtatgctgtgaaattcctactatttatcttttgtgtttgactatccgtagggctgtaagcttactcagagctcacatagatgcgtccaggtactgtaagtcaacgactgtgcttggtctctgccctgttcttgttctgtgaagtgaagaaggcctcagatgcatttggtttggtgaggctagaagcacttgtatttgctacctctgtgttac

SEQ ID NO: 258319 - DNA, 217 bp, Homo sapiens
aactttgcagggatttcatcgctctggaatacgaatgtggcaaaaaatcccattgtgtctagtgggggcgaaagagaataacaggcaagcagcaaatgcttgtcagctttctcatagggtagctttccttttaacacgtgtttatccatgacagtttctgcttcatacttgaaggcattgttgaggaggagaggatcctgaagatggtgaatctact

SEQ ID NO: 258320 - DNA, 217 bp, Homo sapiens
gtataagcatccataatctttgttttttgagaacagttatataattacagaaaaatgtgaagatagtacagaaaattcctatatacgctgaacccaattacccctattattgacaacttacgttagtatggtacatttagttaatgaaccaatattaatgctttattattattattattattattattgtaaacttttttttaagttctggagtaca

SEQ ID NO: 258321 - DNA, 450 bp, Homo sapiens
tagaaatataccagtttctctcccaaagtggagagaaagggatgttatcagatgactttagctgaatggaaatatcccttttttcctatttaatttttctccaattttacagagcatttttttcatattttgttttacagtcactaaaaaatttggattatctgtagttccaacttctgaccaccaatcccactccaaaatcagggaggcagcaagggttatgagaagtacacagatctctcaaacaggccaatgtctaagaagagtatttcttaaaaatttttttcttttcttattacaattatgactacataagaagggtatttcttgaatggagatctgtgttctctcagactctagtctcagttgaactccagtctcagctctgacactaaatagtgttaaaaactcagggttccaatttcctcttctgcagaatcaaggtgtgcc

SEQ ID NO: 258322 - DNA, 509 bp, Homo sapiens
ctctgttacttgccttctctacaaaactgcttttctgactaataaaggcatggagtagtttttgtaggcaaggagaaacaattctgggaaaaagctttgtaaggagcaatattaatagacatctatgcccaaaatttgattcctgtggtattttccctacaaatttcttataggctagttcaaggagaaaagcatcataaagtttgaaagaccagctaaatcagtggaaattatactctcccctttcccattaagaactctattctcttactatgaaaacaccactgttctttcttatctcagagtgcagccttttctgtatactgatgccaaatgggtaacattttagtgagacatttgaagttgtgatatgcaactcggtgggggacaaacaaggtcatttaaaaggtctcttcattgagaacatcagagctttcaaaagaggcacacagcctttcccgcataattgggggtaaatgaagaaaaagcccataaagtacaaaaattaa

SEQ ID NO: 258323 - DNA, 688 bp, Homo sapiens
ctctatccaaagggaggtgaccttgtcctcagactggagtgaaacatgatacactaaatcttgttataacagattgacgcctaccctgggaggggaagtttttcttaatgaaggccattagctagtttgcatgattacatttatccatgctccttatctatctctccacacctgcccttctgaggcacacaaagacatcctccttgacacactcctcctacccaggtgttattgatgtgttgtagagggtaacctctgccctcaagaatgtgattcaacagtctgtgaatctgtggtttgcctgtcccacaggattattgtggggatgaacattaaaatgagatcatatacattaaatctaatgcattatgtaaatgtaaggtaatgttatgtttctaagcctctagacattttccatctttggaaaataatagaacaatgtcaccacaagacaaatgttcagctgttcacagaggaagttgaactctgaccccccttgagcgttccacacatttgttaacatccatttctcgatgatgtccatttatttaacacctctgatcaataacctcgtttctccccagtctctcttttactagcctcttcggtagatttaattaaagtaatgcactttatggggatatgaaaccaggcacttgattatgtcacttcctggtgcagttcctca

SEQ ID NO: 258324 - DNA, 650 bp, Homo sapiens
  misc_feature (93)..(93): n is a, c, g, or t
  misc_feature (140)..(140): n is a, c, g, or t
  misc_feature (172)..(172): n is a, c, g, or t
  misc_feature (243)..(243): n is a, c, g, or t
  misc_feature (251)..(251): n is a, c, g, or t
  misc_feature (298)..(298): n is a, c, g, or t
  misc_feature (386)..(386): n is a, c, g, or t
  misc_feature (467)..(468): n is a, c, g, or t
  misc_feature (608)..(608): n is a, c, g, or t
aatggattggaatggattgcaatggaatgaaatggaatggaatggaatggaatcaatcattccgagtggaatggaagggaatgtaatggagtngaaagaagggaatggaatcaacccgagtggaatgcaaggcaatggantggaatggaaaggaatggaatggaatcaactngattgcaatggaatggaatggaatggaatggaatggaattaatcggaatagaatggaatggaatggaatgnaatggaanggaatggaatcaacacgagtgcaggggaatggaatggaatggaatgnaatggaatggaataatccggaatggaatggaatggaatggaatcaactccattgcaatggaatggaatggaatggaatggaatagaanggaatggaattaacccgaatagaatggaatgcaatagaatggaatgcaacggaaccgaatggagtggaatggaatggaatnnaatcaacccgagtacaggggaatggaatggaatggaatgcaatggaatggagtcatccgtaatggaatggaaaggaatggaatggaatggaatggaatggaatggaatggaatcaactcgatggcaatcgaatggaatgnaatggaattaacccgaatagaatggaatggaatggaatggaa

SEQ ID NO: 258325 - DNA, 553 bp, Homo sapiens
aaagtggtgagtgcctctaagatcatacttggcacttgggcatgcacttttcaagaaatatagggagttgatgcccatggggccatgtaaaagtacaatgagaaggcagctgtctgcaacccaggaagagagccctcaccaggaaacaaatctgctggaatcttaatcttggactgtccagtctcctggaactgtgcgaaataaacgtctattgtttaagccatatttggtattttgttacggcaaccacagctaatataataaatagttccaataccataagaatctcttgcgttgctgttttataatcaccttccatttcaaattttgtcatttaaaaaatagtacataaatggaattttacagtatgtaactctttagcattggtttttccacccagcataattccctggagatccatccaagttggtacacatatcaataggttgttcttttttattgccaagtaatagtccacgatgtgtttgtaggacagtttgtttaaccactcaacaaactgaaagatatttgggatgattctagtgttggccat

SEQ ID NO: 258326 - DNA, 562 bp, Homo sapiens
gtcaaaagttatttagaaaagcatctgtgcgcccccgtttcaacactaggcagaggccccagtcctgccacccgcaggctggtacactggtggtcagagaaggttaagctccagagttccatggctcccaaccttcctagagccctccctcctgcctggtaacccaccattgcgctgcgtcttgcccaggtgtcctggtgggcaggggcaggagttaaaggtggtgccaggaacaagaggtccttcctatattcctttcaggggacgtggcttctagggagcctccgcagcccaaagagaatgctgaaatgcagagtgccagaaggaggcatttgaaggaggcgcggatgagtggaaccagtactatcacctgaattccatccccgtcttcatgtctgcagccccgcgagacacacctgatgtttcttcctttaggtccccagagctgcaaggctgtggtctggaacactcagaaacgggcactgttcatttctcccatctagcagaacttctcaacttggaagaacttgccaccacactttaataaagcagcttaccttta

SEQ ID NO: 258327 - DNA, 353 bp, Homo sapiens
caggagctcccaacccctttgcaggctggctggccagagagagaatttcggacaggatttaggcctggaatttccctccaaatgggcggtgtcgatcagggtaaaatgaatacgtggacatttactacggagacaaagttggaaagaacctgctaggcagagggaacagcacagagtttccaggagtactgcctaaggagaacatgcgcgagaaggaagcccacacagaggagagcagagaccaagccctgcagacattgtccgggctgtgccaaagacagactcacccctggactcttcagtgatataagccaataaattacttttttgttgttgtttttgtcttaagcaag

SEQ ID NO: 258328 - DNA, 369 bp, Homo sapiens
ctgtgaggtccagctccaaccaatggagataggacacagcagtaaggacccagtgcataggggataaatattcctgtctttctttgttcagtgtggtctcgtggcaagattgctgacaagcagcaccttttctgcagtaagtaaaattgccttgctgtgaaaactttttgtctgaatgctgatttctccttgcggcaccaaggaacaagcattttgtttctaacaatggataaatgttggagaagatggatatgctaattaccctgatctgatcactagaaattgtatatattgaaatatcactatgtaccccactgatatgtacaattatgtgtcatttaaaaaataaaataaatagctggaaacagt

SEQ ID NO: 258329 - DNA, 455 bp, Homo sapiens
aactttttcctgaaatgcagattagtttgaaatgaattttatttacgggttcatttttaatgtttgaacctgcttctaggtagggttaaagttgggtgacttgatgactcacgaaatacacaactatgaagtttggaaagtgtggtggtatgcacctgtagtcccacctgctctggaggctaaagtgagaggatcacttgagcctaggaggtaaaggctgcagtgagccatggctgtgcacttgcactccagtatggacagcagagcaagaccctgtatcaaaaaacaaataaaaacaataataattttttttaattaaaggagaaaagtttgggaagtttgacttacatatttgatcctcgaatagggagttattttggttttggcattagatagttttgtagcttggttcatggcacttgagcagcaaattcatggcccttacactgaatact

SEQ ID NO: 258330 - DNA, 605 bp, Homo sapiens
tgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatggtaagttccactgctgttctctcaaaacagacccataatttcttttgatgcataaatatccctcatgggcatgtatttattgcaggtgctatgcagtcatatacgttatacactgcagaggtaatgcactggttgttgttcttgttctttcctaaaactcagaaagatatttttatattacttctcagcagtatgaataataagatgaaatgcttccctccactgtttatgtactcatgtattttgtataatcatataacaatatatcttaatgagtaagtccatattacttaccaatagaagtcagaaatcaataaaatgttattaaatgaattgaatttcaattgccccacttatgctgccatcctttttgcatgtcaaataaagcaaatagtaagaatttttaaaactataa

SEQ ID NO: 258331 - DNA, 657 bp, Homo sapiens
ccttttgaaaggttttcaagattgctgtcatatggggaaaaacatgcaaacttcaagcttggttctccaggacaccctcttagaaatgactcacgcccttgtgcagagaggaccttatttctccagttcctcctggtctgacctcctcattctagtgagccactaacagcagggctcagtgcactctgtggccatgagaaacaggaaaacagaaataaatgggcttctcatttttgggtgaaaccctgggttcttgcagtttcccctgaaatagatccaggtcacatgctcagtgttgtcatgaaactgaaatcagaggtagggaaagtccagatgtttgttctccaccagagaaaaaaaagggcggttctctttacctcattttctaaataatcttcctaaaaacaacaaacaaaaaagtgacatttgatgggaaggcatgtcttataatgagcacaattctcctcactggtcttgaagcccaaggctataaacagagtcatggctagggagctacagaatattagctcatgtgggaaaaggaagggagctgttggctagaactttgcttcatgtggggaaagcataaaaatattgtgggcagacttcagctttgtgtcccctggtaagtttgactcattagaacaaaacaagaca

SEQ ID NO: 258332 - DNA, 343 bp, Homo sapiens
ggtgcccttctacaagggccaggacctcctccaggccacagcagtcacctggatgatgagggctccaggaggcaccctcaaccctggaattctctttttcaaataagagatccaggtgagaaccgtgaggatgggcacttggacaggaagaggttgctttgtcccgagcagcaacaacgttggtcactcaagccttcaccaggttctgctccacacagaaggaaggaaagcccatctcatcaggccttgggcaccaacaacacaaatagttccttgctagcaatacattttccgatatgtttttgcttcttcctctaacgtttaaccttgggtatatttcaaa

SEQ ID NO: 258333 - DNA, 987 bp, Homo sapiens
tgtactatcacttgagagagacaagagtctgctagaaggtagagaccttgtatgctgttccctgatgcatcctctggctagcagtgcctgacacacagtaggtgtgcagtaaaggtgtgtcggatgactgagtgatctccaccctcatggagctcgcagtctgtgtggacaagacacagggcaggagaacagtgtaagcacagcctgaagaaatgaggatccagcctctgctttcacacctgtgatgacgggggtctcaccacctcctcgacagcaatgaacatgaaaggccttcttggcagcgagctcttcatcctgttgctcctgaacccaggacttctaatagcgtgcccatgaaatttactgaattaggaagggagggaggaaatattcctgcctgaggtctctgttttctgggcccccacgggccccctctgccccctgccccaggtcaccttacaaacaaagaccccaactcagggtctcggctcttcaggcatccacccccaagtccccttttgggagcagtgtcttcagccacctccctggacgcccttcccctagtaggagcccacagggccagcaggagagtcaccatccttgcctctccatggccccaaaagaaagtctgatcccctcagcctatccctgaaggccaggccaggacccacgaactggcaccaccccagccctgctcagccaccacgtttcccaaatctaggtgcccagcctccaggcctttgccctggaacttccctcttcctggaaggccctctctccctgcccccatcctggcagatgaaatccctaaaagcccacggcaaatgccgcaccctccatgcagccctcgcccaccctcgcaggcacagtccctccacgctggtttcgtgtccacagaacctttccgtggccagaggacccgaaacccccacggccctgtgtttttgagcccctgtgggctctggcgcgtgtcggtgcccagcctct

SEQ ID NO: 258334 - DNA, 635 bp, Homo sapiens
  misc_feature (140)..(140): n is a, c, g, or t
catatctagaccttgaagttttgatatcaaatgatctggtgtaatagacgtggctaaacagtgtgggacagtcaggagttttttaggaacattggcttgggagttggacagagctgcattctaaccttggctgtgccaantactcgccaagtgatctacggaatatgctagggaacatctctaaaatggtttcttcattcctaaaatgtcgggggtgcctattattggtgatgttgagaagcacagtgtccagctattcgggaggctgaggcaggagaatggcgtgaacccgggaggcggagcttgcagtgagccgagattgcaccactgcgctccagcctgggtgacagagcgagactctatctcaaaaaaaaaaaaaatctgattctcatgtttgtttttaaataatagctgtatctgaacaaccaagtagaatatgtctttgctccatagcatcattgctttaaacattctaagataaaattttagcagaattggcaaaatgactaaagtctttattttagacatcattcgcattgggttaagaatgtaacatcagaatatgtacaaacttacaatttttattctatttttaggttaaagccaagtaactcgcttttccattttatctcttt

SEQ ID NO: 258335 - DNA, 696 bp, Homo sapiens
gaaatgcccttttccaaggtctacctatttgcaaattataatcctctgtgcctggtttttgaagagaataatttataaacattgcacaatcctgtgtcttacattgcagagctccagtgttgtaaggtttgatgaaattaagcatgtcttcctttttgaaagataccaattttaattattttttcattacaaaataaatcaaattcagaacacctgtaataaattacaaacatgactgaaatactttacagtatcttccatcaagaggtagaatctctattcctcaacggcttgaatctgggcttgtcttgtgacttggtttgagcaaggaatctgatagaagtaatgttttgaatgttctcagctttggattcaagccctcttgaagcttctgttcttgcaggtaaagaagcataagctagcttgttggataatgagaaacatgtagcccagttgcccctgtcagtccaatttacaacaagtcaacccctagaagcagagctaggtgacctgcaaacaagcagatatgtgagtgagtgagtgagtccagttgaaaccagcagagaaaccatatagctgaacgaagccatgtagcccaagcagtcatcccccagaacattgagctaaataaagggttgtgttttcagtcttttaagtttctgggtgattctattatacagcacaaaatactgatgc

SEQ ID NO: 258336 - DNA, 684 bp, Homo sapiens
aaagaaagaaagaaatatgagaagaggacaaagagacatacatatccttaagaagtccagagatgcacaagttgcgtagcaactgatacatgctgtcaggggttaagcaagacacagaaaaattgtaggtgataagtaatattttaagaacttgtgtttaaattatttaggtaagacattatgtgtggttaaatatcagaacttgtgaaaaacagttaacaaaaaaacttggtatccgaatctctcttttacaaggaagccaagaaatatatacaattgtatattaaaatcagtggcagcattctttttaccacttatcatctatccatttgtttaacaaatacttttttggtgtctctcatgtgccaggatgctagaaataaagaaatgaatgaaataaagtccttgcccccaaaagctcactataaagtggataaaacaaatatgcaaataaataattacactatagattgataatcatcattccagagacattaacaaatccataaaagtacgaagtgacaagctctgcccataaggaaccagagggagcttgacctgagcatttgagttaggtctcgaagggtgaataggaatgtgccatgcagagaaaggacagaactttccacagagaacaaagaggttggactctatcccattaatgcagagtatcccaactgctgt

SEQ ID NO: 258337 - DNA, 553 bp, Homo sapiens
cagccaacaagaactgccagatgtatgagtgaggcatctttgaatctttgaccttccagccatccagtcctccagtggaggcaaccacatgagtgagggaacgcaggagaaattagcaaaggtatggcacaggcaagctcattgtgattttgtgaaatcatgaagaatcatgagaaagaataaaccactagaattttaagctcttacgtttgggataatcgacacctaaagacaaatgggctgctgccacaagaaaaatttaaaatatgtcaggcgcggtgtctcatgcccataatcctagcactttgggaggccgaggccggtggattgcctgagctcaggagttcgagaccagcctgggcaacagtgtgaaaccccatctctgctaaaatacaaaagaaattagcagggtatggcagtgtgtgcctgtagtcccagctactctggaggctgaggcaggagaattgcttgaacctggaaggcggaggttgcagtgagccaagatcatgccactgcactccagcctgggcgacagagcaagactccatctctc

SEQ ID NO: 258338 - DNA, 199 bp, Homo sapiens
cggcacgaggcgaacaagctactcagcctagaagtgtcatgatttgttttacaaaacaaggatgataattatcatagcgcctaccacataggttttgagaatcaagtgagttagtacatagtgcttggaacagtgcctgatacacagtaaacttcataagccttttctttttgttattatttaatgtgctcacatcaaa

SEQ ID NO: 258339 - DNA, 452 bp, Homo sapiens
tcactgtgtgccgggccaccgttttcccttccagccaccggcaccactagcctttgatctttccaaggccagagggggcatgggagctgctgggctggggccgctgagcctcctggagtctgatgtggcttccatgagagtcaggccaggaccacaggtgcctcctgagtccgtgggtctgggcccaggccctggtgctctatgagtgacacttgggagttaccgtatgtgccaaggagcagtgagacacctgtggtaatggcgagtgacctgtcctatgggctgcacagctggaggatggtagaattttggagcaatagtgggcagtgtgttgttggggaagaacatgggcttctgaatcagaaaaatatgaattcaaaacctaccgctgtctcttgttagtcaggggaccttggccaagtctcaataaatgtttcttcatctggagatga

SEQ ID NO: 258340 - DNA, 430 bp, Homo sapiens
gcaagtcccatcttccgtgaatggtggcaggcaaaaagagagtttgtgcagggaaacccccatttttaaaaccatcagatctcttgagactcattcactatcaagagaacaacacaggaaagacgcacccccataattcaatcacctctcaccaggttcctcccacaaaacgtggaaattgtgtgagctacaattcaagatgagatttgggtggggacacagccaaaccatatcacaagatcactcagcaaataaaggatggagctggaattcaagcattcttcccctcatgaccctcccagtggctgagggatggcatcttgtggcagaacttggtgtccaccttgtcctagccaaggtcacgtggcagggagtgtcacacctggattcagcccagttgtgctggcctgcagagctctaccaccctaaa

SEQ ID NO: 258341 - DNA, 229 bp, Homo sapiens
gatcaggtttatgatttcaaatgatgcctctggctgtaggttcaagaatggatttcagtgagcaacgtggatgtggggagaacaactagagagtgttgtaacagtccacatacgagatgtccataacttggacatggcagtggggatggagagaagttagcagatacaagaaatgtttagtcgatgactgacagagaggttagagaatgggagaagtcaaggatgactc

SEQ ID NO: 258342 - DNA, 601 bp, Homo sapiens
tgtctctgaaaaaggactgctggttttccacaatctttgagaattgtggttggattgggaagtatattagttccttcttaagctgctatgaagaaatacccaagcctgggtcatttatatagaaaagaggtttaattgattcacagttctgcatggctggggaggcctcaggaaacttacaatcatggtggaaggggaagcaagcacatccttcttcacatgatggaaggaaggagaagtgctgagcaaaagggggaaaaccccttataaaaccatcagatctcatgagaactcactcactatcatgacaagagcagcatgtgggtaactgcccccaagactcaattacttctcactgagtcccttccacaacaggtagggattatggaaattataattccaggtgacatttgagtggtgacacagtcaaaccatatcagaaagtgttactaaaaagaactgaaatgtctggccaatattgtcactctttctttccatgatatttattctctgctgagttccctgcattttattccctaattctttcaccccatagcttcttggaaaatgcatcacaaggttccaagtatttagcaatttc

SEQ ID NO: 258343 - DNA, 137 bp, Homo sapiens
tttttttttttcaagtgaattaccttaccagagaagtgtcaatcaatttagcagcaaaataagccaacgtagccagagggagcagagggtctggaactgtggctcctgaacctgtctggtcattagaatcacctggg

SEQ ID NO: 258344 - DNA, 534 bp, Homo sapiens
ggagcaaagactatctctgggacctgaaaaccattctttgaaattctttccctggtgtgcctgagtctttcttaacttggtggttccatgttgaaggagttgttaaatgcagccccgggggcgggggatgggtggggtggtgggggaagttctgaactgtagtttaaaaagctttcacaaacattttggttactcagtttggatggtgttctttaagtgagttttattgactcgtggaatcattgatgacagattaataatttaaggttcaagtctggcattgctatagagaaatacctgagcatttggcaggccaaggtgggcagatcaggaggtgaggagatcaagaccatcttggccaacatggtgaaaccccatctctactaaaatacaaaaaattagccaggcgtggtggtgcgtgctacttgggaggctgaggcaggtgaattgcttgaacccgggaggcggagcttgcagtgagctgagattgcgccactgcactccaccctggtgacagagcaagagtctgtctca

SEQ ID NO: 258345 - DNA, 396 bp, Homo sapiens
ctctcctgcttctgttatatttatttttgttatgttgtttatccaaagggggcattgattataacagttagtaaaatactggtgtggctattcacctttgttagcttatatgtcttaagtggtacaaacaaagccaagtaagtgtctgatgtgagatccttaaaaccgggaggcctgggtgctccttcttcccctgactccagtattcctgccctggacagtgagcccacctgaagctctttcctgaggtcccacaaagaagggtctgatggttttatcaggaaaaaaataattaattttttaaaattttaaatggaaaaaattaaattagttaaaaattaaaaatggctcttttccttgtttctcttgttttttgatgaccaatacctaaaaaag

SEQ ID NO: 258346 - DNA, 746 bp, Homo sapiens
agacacatgcataaacatgtccttgaagttttggaaaaatgtagataaagagactaggatggtattagattctcattggcatccctcaggaaatggatttgaacttagatttctgtatcttgctaacctagtaattaggaatgaggttcacataaacctgattcctggacattcatggactgagaaagtttatctcctttataagttacctctttgcttcttaaatggttacttgcatatatactgcagcaaagtaagtaaaccaagaaagaggaatacatgagacctaagacacagtggattcaatccagagaagtaatgaagggcagcatcaggataactgaagagcagccagttcagaagagagaaggtggtaaaattcctccaagcaggtcttctccatgatgggggagagggaggcaaggagcaactccatgcaatacagttacatttgagaataagggggctgggcacagtggctcacgcctgtaatcctagcactttgggaggccaaggtgtgcagatcatgaggagatcgagaccatcctggctaacactgtgaaaccccgtctccactaaaaatacaaaaaattagccaggcgtggtggtgggcgcctatagtcccagctactcaggaggctagggcaggagaatggcgtgaacctgggaggcggagcttgcagtgagccaagatcatgccactgcactccagcctgggtgacagagtgagactccatctcaaaaaa

SEQ ID NO: 258347 - DNA, 2335 bp, Homo sapiens
agccatgcgtctctgagcgccccgagcgcgcccccgccccggaccgtgcccgggccccggcgcccccagcccggcgccgcccatggccgaggcccccccgcgccgcctcggcctgggtcccccgcccggggacgccccccgcgcggagctagtggcgctcacggccgtgcagagcgaacagggcgaggcgggcgggggcggctccccgcgccgcctcggcctcctgggcagccccctgccgccgggcgcgcccctccctgggccgggctccggctcgggctccgcctgcggccagcgctcctcggccgcgcacaagcgctaccgccgcctgcagaactgggtctacaacgtgctggagcggccccgcggctgggccttcgtctaccacgtcttcatatttttgctggtcttcagctgcctggtgctgtctgtgctgtccactatccaggagcaccaggaacttgccaacgagtgtctcctcatcttggaattcgtgatgatcgtggttttcggcttggagtacatcgtccgggtctggtccgccggatgctgctgccgctaccgaggatggcagggtcgcttccgctttgccagaaagcccttctgtgtcatcgacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggagctgatcaccgcctggtacatcgggttcctggtgctcatcttcgcctccttcctggtctacctggccgagaaggacgccaactccgacttctcctcctacgccgactcgctctggtgggggacgattacattgacaaccatcggctatggtgacaagacaccgcacacatggctgggcagggtcctggctgctggcttcgccttactgggcatctctttctttgccctgcctgccggcatcctaggctccggctttgccctgaaggtccaggagcagcaccggcagaagcacttcgagaagcggaggatgccggcagccaacctcatccaggctgcctggcgcctgtactccaccgatatgagccgggcctacctgacagccacctggtactactatgacagtatcctcccatccttcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaagcagccggatgggcatcaaagaccgcatccgcatgggcagctcccagcggcggacgggtccttccaagcagcagctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgaggatgccccctcagaggaagtagcagaggagaagagctaccagtgtgagctcacggtggacgacatcatgcctgctgtgaagacagtcatccgctccatcaggattctcaagttcctggtggccaaaaggaaattcaaggagacactgcgaccgtacgacgtgaaggacgtcattgagcagtactcagcaggccacctggacatgctgggccggatcaagagcctgcaaactcgggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtggg

SEQ ID NO: 258348 - DNA, 633 bp, Homo sapiens
caaggtcccacaagaagtgccaagactatggctgggcatggtggctcacacctgtaatcccagcaccttgagaggccagggtgggaggatcacctgaggtcagtagttcgagaccagcctgaccaacatggcgaaaccccgtctctactaaaactacaaaaattagctgggcgtgatggtgtgtgcttataatctcagctactcgggagcctgagtagtgtgtcagttcctccctgccagccagtctgcctgggcgtggtagtccttccagcccctgggcttgtgctaagtttctttctgtaattgctccatctggctggtctgagaagcaggttcaaatggcaggagaatcacttgaacccaggaggcggaggttgcagtcagcagagatcgcgccattgcactcaagcctgggcgacaaagcaagactccatctcaaaaaaaaaaaaaaagtgccgagatgaaggagggtcgagagatctggtcctggcagacaagtgggactttgcccattgagaggcaccgatgggtctttagtccaaggctggtgcatggaatgacatggaaggaccagggtgctgtgttgctggggagggggaccgctcatttaatatggctgcacgcaaggcctgg

SEQ ID NO: 258349 - DNA, 717 bp, Homo sapiens
  misc_feature (565)..(565): n is a, c, g, or t
gttaatagctagctgaattcacacttcagtattctcccaacaggaaactcctttggtgggtgggggagccaaaggcatctgtattttcaggaggccctgcttaagtttggataatgtttatttctgtagctgctggttgtacaggcattttcagtttaaaataattttcatatcacttttgtaggccattaatttcttcagtaatttctcagcaactcatagcaccccagtaagatcatggcaaagctcacacatcacccacctgtatgattgtagaggggccaagggaaagcgtccgtcatcctgttaagggtttgttgaaaattgttgatgaaaagagtgaaactttgtaaaatatttaagagatttattctgagccaaatagaagtgaccatagcccatgacacagccctcagaagaccctgagaacatgtgcccaaggtggtcggggtacagcctagttttatacattttagggagacatgagacatcaatcaaatacacgtaaggtatacattggttcagtccagaaaggtgggacaactccaagtgggcagagagggtnaggtaggtttccttggtctttggctccctctttcgcttcctcttctctcggccttctggctgcctgttctttcctttcttctgatcggctctttttgcgtctccctttccgcgttctttgtcatctccattttcttctctgctcctcggcct

SEQ ID NO: 258350 - DNA, 184 bp, Homo sapiens
tctgagggggtttcttgtcagctcagcaggtttttgggttgcaggtttccacgtctatcaaatggggactatcatgcctacttcagaagagcatctgtgcagattgagtgaccccccagcagtgtctgcatgtagtaggtgctcagccatgctccccaggccaggacacagcgctgcccactcc

SEQ ID NO: 258351 - DNA, 543 bp, Homo sapiens
gaatgggtagagctgagtgggaaggagaagccaagccccaacaaagctccatagtccaccattggtggctagctatgtgctgagacttgttatagcagtagaaatggaggcctgtgtgtatgcctggactccagtgaactggggagatagacgtggcttgtgtatggctggtgtcacctcagattttaccttttgagaccaaggtgcctggtttctgtccccagtagttttattgtcttggtctgtaccatccacgtccttcccatcccctctttttgtcctctctcctctcaccttaaaggtttttcattttcagtttattgatttagttctaccctgtggtgggattcataatgggaaaagggagtttgaagtagctacagcctaagggtgattggaaggagttggggtggacacctgagttccttcccttcattttagagagaaccgtagtccgcggaattcttgatggctggtgggctagatgtagggttgaagaggcagctcccagctccaggctggagaattattgcctagtccaag

SEQ ID NO: 258352 - DNA, 809 bp, Homo sapiens
  misc_feature (808)..(809): n is a, c, g, or t
gtgcaatggctagtactatgtgtcaacttgtctaggctatactgctcagctgtgtggtcaaacagtagtctagatgttgctgtgaaggtattttgtagatgtgatcaacatttacaatcagttgattttaagtaaagcagtttaacttccaatatgtggatgggcctcatccaattagttgaaggtgttaagagaaaagaccaaggtttcctggaaaaggaattctaccacaagactaacataaaaatgcactgtgagtttcatgcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaaagggaggttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaaatgaacatgttgtaaaatgaaaaaaaaann

SEQ ID NO: 258353 - DNA, 786 bp, Homo sapiens
  misc_feature (785)..(786): n is a, c, g, or t
tccctgggttcacggcaagggtggaaccggattctgcccggatggggatctggatgggggggtggggggttgatttgggaagcagagcacagcagcccaaatttgcttgtaatgtcggcggctacagaggaaaggccaagaatggacagattaataaagggccatctacaagccacgaataaggccatcaccagaagccaaccccgccagtccttgatctaggacttccagacttcaaaactcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaaagggaggttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaaatgaacatgttgtaaaatgaaaaaaaaann

SEQ ID NO: 258354 - DNA, 855 bp, Homo sapiens
  misc_feature (854)..(855): n is a, c, g, or t
gtgcaatggctagtactatgtgtcaacttgtctaggctatactgctcagctgtgtggtcaaacagtagtctagatgttgctgtgaaggtattttgtagatgtgatcaacatttacaatcagttgattttaagtaaagcagtttaacttccaatatgtggatgggcctcatccaattagttgaaggtgttaagagaaaagaccaaggtttcctggaaaaggaattctaccacaagactaacataaaaatgcactgtgagtttcatgcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaaagggaggaagtggaaggcatcctctcaaccctggcccagaagccctatcaaagttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaaatgaacatgttgtaaaatgaaaaaaaaann

SEQ ID NO: 258355 - DNA, 832 bp, Homo sapiens
  misc_feature (831)..(832): n is a, c, g, or t
tccctgggttcacggcaagggtggaaccggattctgcccggatggggatctggatgggggggtggggggttgatttgggaagcagagcacagcagcccaaatttgcttgtaatgtcggcggctacagaggaaaggccaagaatggacagattaataaagggccatctacaagccacgaataaggccatcaccagaagccaaccccgccagtccttgatctaggacttccagacttcaaaactcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaaagggaggaagtggaaggcatcctctcaaccctggcccagaagccctatcaaagttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaaatgaacatgttgtaaaatgaaaaaaaaann

SEQ ID NO: 258356 - DNA, 255 bp, Homo sapiens
tatctttggttatttagctgtaaatgttatatgtgtttatacaagagtagttcatggttctcaaaggatacataacctctctcgtcactttcctcctctgacccagcagtaccctaactttcaatctttaacatcttacaatctgaccatattgtcagactaatactgggctggttttatttaaggctaaataagagctaactagatgaactaagaaaaatatctactaaaatctgctatgagcatatgtattgc

SEQ ID NO: 258357 - DNA, 309 bp, Homo sapiens
ttcatttttgtatatggtatgagagaggggcccaacttcatctttcgcatttggagatccaattattttagcacattttgttgaaaaaaagaactattttatgatcattaagttattttagcagctttataaaaattaattaatcataaaggtaaggaatttatttctaggctttcaatgatatcctattgatctataagatcaacagatttgatatgtttgatgatattctgttgtgtttatctttaaaacaataccacccagtcttgattactttactttgtagtaacttttaaaactgggatatgt

SEQ ID NO: 258358 - DNA, 427 bp, Homo sapiens
gtataaaagacaatcaagttttttctggtttctagaagattgaaaggtctcaaactgttcgcacttcagttgatgtgggagatgagtgagggtcagtcaagtgtagaggagacaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaat

SEQ ID NO: 258359 - DNA, 355 bp, Homo sapiens
gcggccgctactactactactaaattcgcggccgtgcgaccaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaat

SEQ ID NO: 258360 - DNA, 261 bp, Homo sapiens
cttgaagttttaatgaggaataatagccacatttggcctttttctccatgtacaaagctttacatttgtttgctttctggaacaaaaacaaaagtgtgtcatgttgtcagtcttgggctggacatgaaataaaagagtcaaattgagatggaatgtcagcaagaaggtttagttttggctgtggggtttccaagcgtgagcttcctggcccctgtgacactggaaagagtggctcctcccagaaggagctaacagcacagg

SEQ ID NO: 258361 - DNA, 289 bp, Homo sapiens
gctatgattgcaccactacactccagcctgggagacatagcgagaccctgtctcttaaaaaaaacaaacagaaacagtgggtgggaaaatacacatttttaaatattgagtcttcctatccattactttgttttatctcttcaattaaataggttttctttaatgtcttacagagttttgtgaatgtgtccagaaaagtcatacaaatattagttttgttcctggatataattttttttttttttgtagatgtaagtggtatatatatatttttgagacagagtctcac

SEQ ID NO: 258362 - DNA, 410 bp, Homo sapiens
aaatgtgaccaaggatgtgatagatctccacaatgaaaacttcaagacactgataaaaaaaattgaagaccacacaaaataatggcaaggcattccatgcctatggattagaagaatgaaaattgcttaaatgaccatattacccaaaacaatctacagattcaatgcaatcccacccaaaataccaacgatattttttacggaaatagaaaaaaatatcctaaaattcatatgggaccccaagagacctcaaataaacgaagaaatcctgaggggttgggggaagcaaacaaacaaagctggaggcatcactctgcctgacttcaaaatatactataaggctatagtaaccaagacaccgtgatattgttatagaaacttaaaggcttaaatggaagacttgaaactat

SEQ ID NO: 258363 - DNA, 680 bp, Homo sapiens
gggaaactgcccccatgatcgaattacctccacctcatctctgccttgacacgtggggattataggcattaatttcaagatgagatttgggtggggaaacaaagcttaaccatatcattctgccccagcctctcccaaatctcatgtccctttcatatttcaaaaccaatcatgccttctcaacggtcccccaaagtattaattcattccagcattaactcaaaagtccaagtccaaagtctcatctgagacaagacaacccccctcctccgcctatgtgcctgtaaaatcaaaagcaagttagttacttcctagatacaatgagggtacaggcattgggtaaatatgccccttccaaatgggagaaattggccaaaatgaaggggctataggccccatgcaattctaaaatccagtggggccatcaaatcttgaaactccaaaatgatatcctttgactccatgtctcacattcaggtcacactgatacaagaggtgggctcccatggccttggtcagctccacctctgtggctttgcagggtacagcctccctcccgactgctttcacaggctgatgttgagtatctgtggcttttccaggggtgtggtgcaaacagtcagtggatctaccatttgggggtctgtaggactgtggccctcttctcatagctgcactag

SEQ ID NO: 258364 - DNA, 337 bp, Homo sapiens
ctatgtataggattcggtatgatctgcgatttcaggcatccactagggtcttgaaacgtaacccttggataagggggtactactgtacttcataagggcaagggtggttatgtattaatagaaatattcttactcaagtatatgtgaatacatttttgtaaatattcatcaatttggagtataaaagagaaaatactgaggcttcccttcagctctactttccagagttaacaccattaaaatgttaatacctgtttttataggccccttctccatgcatttatatatgtgtataaagtagtattataatgtgtatgctacttttcagcttgattta

SEQ ID NO: 258365 - DNA, 303 bp, Homo sapiens
actgtatacaagcaccaagaagaatgtgacacgaacgccagagtcctcagatgaatgccctggctgtaatgagcagtaggcactgtcacatggccacccatggagggcctgtggcctgacgggagcgggagggcagctcggcagcccgccttagcgtgggcactcacacggagctgccacttgtagtttctacgaagctctgggctctccgctctgttttaaaaagaaaagaaacattgcaatatcagtcacaatggtaacaagagaatttctaaagcatctgctcagtttctcgaaattaaa

SEQ ID NO: 258366 - DNA, 351 bp, Homo sapiens
aaaaatgattatgaaggttatattgagtcagtggaagaagaaccttcaacatcaggatgtggtaagagccttacccattttatctcagagggccttctgttgcctgggacagcaatgtgaccaaaatggcatttggagaaactatggaaatggtccagctaaagggctatctcttgttctttagtcggttggatgtagagataagcacatgtagatcctacctacgtgaaagatggggggtgggggtaatgcgtattttaattagccagatctagccactttatgatgcatgcatattttcttttctttctttctttctttctttcttttttttgagacagagtcttgctc

SEQ ID NO: 258367 - DNA, 695 bp, Homo sapiens
aggggaaggaaggaagacggttcagtttagcctcttgaaaaatggatacatttgcaagaaggaggaaaaaaccagaatttttgaaaggaatcaagaaaagagttcagaattgcacgggacatgatagcaggaggaaagggaagatgaggtcagtttgcagtgccgaatgttgtgagaggtcaggaaggagctggactgtgtggggacaagtgtgttcagagattgtgctgtctgtggtatctaggagaaggttataagcaggatgggaagtgaagaaaaacacatggcatggagttgagcagtgagaggaaaacctcagtagtgtgctgagaaaggtttaacagctggctctccatgtgggtgagtgggtggaaaccctgatgtgtaccatttgctggattccagtgtgtaaatatttctaccatggccaatttcaagctacccatggttaataactgcctcacaagttccagaaaaacttagccatcagttctcacaagccgttatgagctggctacagtacatcactggaagaattgaaagataaatgcatatgttcatcttctaagccttatattatatgtaaggcattcttttgaacttaaaacaaatatgggcctggtatagtggctcacgccagcaatcccagcactttgggaggccgaggcaggcagatcacctgaggtcaggagttt

SEQ ID NO: 258368 - DNA, 432 bp, Homo sapiens
attctaagtgaagtacctcaggaatggaaaaccaaacatcatatgttctcactcatatatgagagttaagctatgagggcgcaaaggcatgagaatgacgcattggacttttgggactcaggggaaagggtgcggggtggtgagggataaaagactacacattgggtaggtgtaggcgcttagatggtgggtgcgccaaaatctcagaaatcaccactaacaaacttattcacgtaaccaaacaccacctgttccccaaaaacttattgaaataaaaatattttttaaagaaatgaaaaccaatcatgtccaaatcttgtacactaaatgtaaaacttcttactcattattattgcagaatataggtgttccagctcttgggtagaaactataatcagaaattttctcgtttccaattcctatcaagatcct

SEQ ID NO: 258369 - DNA, 866 bp, Homo sapiens
tttcgccatgctggccaggctgatcttgaactcctggactcaagcaatcctcccgccttagcctgccaaagtgctgggtttacaggcatgagctaccatacccagcctagcttttttttttttttaatatgaaaaaaaaatgtttggagccttcccactaaggaacaataagattaagggatttaaaagaattgattagtgacatgcacattgctgccccaggagaaaattctgctattactcatgagaagagccagcatgaagagctctgtgaggtctgaggtcacccttgtaactgcgctcggggatgtcaaagtcagcattgacacaactgtgaccataactcacctgttccaggctctcctgtgtactgcacacccatcctccttctcagtgttcccagcagctgtaggagctaagaagagtgaaagtagctatgaaagacaccatctgtagtttgtttgttccacaaactccggcctctttcctcttgggcacacactaacctgcgtgtcccagcccctggcagttagtgtggctgtagcatgtgggtggaaatgattcaggtatggcccacaggaagccccctgtcattctccacgtctgcctcttccctcatctacagaggactcagggaggactcagccacctaagagagccagaagctggaagggagctggatccctgaatgactgtgtggagcagagtcccctccttaccacctgcctccattggattgtgacatgagagacaaagaatctttctgtgtgaaagccattgccattttagagttattgatcacagtaggcatctcactccatgaactaatgatcttagctacaatcaactgcactcttaccatgagc

SEQ ID NO: 258370 - DNA, 279 bp, Homo sapiens
tcctcccatttttaactctccagtttcgaacctttcttcttgtctccattagcactgccatgatgttttaggaaacatcctttttttttcctaatctctcagtcctcagttagcccttaatcctacccaagctgggccccaaaagaaaacctttcccctttcaccagaaatttcaactctttttcttccccttccttctgctgcacccaggacttcttactccaaatctcttctatggtgttttctctcctctctcagttaagcattgctagagaaaaa

SEQ ID NO: 258371 - DNA, 105 bp, Homo sapiens
taagggcccttaagatccccttttaccaacccctgggagaaggtgctttgcacatgaactccctttctccatttcttgatcaatgaataaagtttcttctccgct

SEQ ID NO: 258372 - DNA, 210 bp, Homo sapiens
gatctacagaaacctagaaatgttatagaaatacccagaataccacaatcagtgcaggtctgtgtttattgttgatgttttgaggactgggggttactgtgagaggttttgcattatgttttgtctaaaataaaagttccagccaggtgtggtggctcatgcctgtaatcccagcactttgggaggccaaggcgagtggatcacgagatc

SEQ ID NO: 258373 - DNA, 355 bp, Homo sapiens
gtcatttctttcatttgacttggatttttgtaacttggtctctccctattaagagtttaagtcagctgggcatggtggcttatgcctgtaatcctaacactttgggaggctgagggaggcggatcacctgaggtcaggagttcgagaccagcctggacaacatggtgaaaccccatctctactaaaaatacaaaaattagtcaggtgtggtggtaattacatgcctgtaatcccagctacttgggaggctgaggcaggagaatcacttgaacctgggaggcagaggttgtggtgagccaagattgcgccattgcactgcagcctgggcaacaagagtgaaactccgtctcagaga

SEQ ID NO: 258374 - DNA, 1212 bp, Homo sapiens
  misc_feature (294)..(294): n is a, c, g, or t
  misc_feature (508)..(508): n is a, c, g, or t
ggggagtctgaagatgtgactcaattcctgcaatctcataagaaaactttaactaatgagaagttgtttcttatggacgggaaaagaacgtggtttcttgagatggaatctactcctggtgaagatgctatgaacactgtcaaaatgacaacaaaggatttaaaatatgacagaagcttaattgataaagcagggtttgagaggactgactccaattttgaaagaagtcatactgtgggtaaaatgctatcaaatagcatcatgtgctatagagacatcttttatgaaaggganagtcaactaatgcagcaaacttcattattatcttatgaaattgcgatagccaccccaaccttcagtaactactaccctgattggtcagcacccatcaacattgtggcaagaccctctaccagcaaaaagattatgacttgctgaaagctgagatgatcgttagcattttttagcaataaatatttttaattaaggtatgtatgttttttagacnattctattacacattttatagactacagtatagtataaacacagcttttttttttttttttttaagaaatggggtctcatgctgtcatccaggctggagtgcggtggtgcaatcatgactcactgcagcctcaaactcctgagctcaagtgatccaagtagctgggactacaggcctgtcacatcacacccggccaaaacgcataacttttatatgcaatgggaaacaaaaaaatgtgtgtgactcactctattgtgatattcagtttactgcagtgatatggaactaagcccacaatatccctgcggtatggctgtacagtataagaatcacctgaagggcttattaaaaacagcttgcttgaccccctcccttagagattccgattcagtagatctgggttggtcaagaatttgcatttctaacaagctcccagctgaggctgaggctgccattcaacatactaccaagtagcactggcatagagagatccctggaataaaatttacctacttgtgtgtgtgtgtatgaatgtgtgtgtgtgtgtgtgcgtgtgcatgtgcgtgtgtgtgtatacagtcttgctctgttgcctgggctggagtgcagtggcgtgatctcggctcaccataacctccgcctcccagctttcaagcgattctcatgccttagcctcctgagtagctgggattatggggtgcgcc

SEQ ID NO: 258375 - DNA, 129 bp, Homo sapiens
gagacgttgtggtgagcaggctgtgagcacgggagcagaagtgggatcgtctcagcagtgctcgggtgtagccaggtgcaagagattattccaggagacagctatagtggggatggacagcgtgtgggg

SEQ ID NO: 258376 - DNA, 636 bp, Homo sapiens
ggtaaaaattgttaccatttagccatttaccattgcttgattctgactcatcaagctttccaatcaatgtgatttttaagtataagccttaactataagccttaatcttcaataattcaatgccattcacatattgttcaggcatttttcctatttatttaagaaatgaatcatctatagttccaatatgaaataaaaaaaactctacaataagccaaatctaaaataatacatgtctattatcactcataatccttgttaatgctttcacaccctaggactgaggttttccttctagtttttcttcccttcaattccttctgtccatttattcttaatttgagagattttatttgttgccttataaccttcttctttgcctttttcttctcttcctttttattctttaaacatacatcttttgtttttttcttttaatcttctgtcttaagcttagactttctcacctgacacccattttctcagcatatgttagtgaaacgggagagttccctgatccctcacaggacttatgacagaggtgtcgctcatgtgctcagccactacaggctcgaactcctttcgggagggcgagcacacggatgggcgggggcaagagctggggcggggcgagtg

SEQ ID NO: 258377 - DNA, 647 bp, Homo sapiens
ttctctgtcttctcttcttccatctctatgacttcagtcagcatcaaaacttaatccaaaaactcatttttgccttctagctacaacaacagtatctgaccacaggacattttcccttcccattgttcttgttcctagggtttttgttttgtttggttttgtttttttgagacaaggtctggctctatcgtgcagtggcacaatcctggctcactgcaacctccacctcctaggcccaagccttcctcccacctcagcccccagagccgctgggaccacaggtgtacaccaccatgcctggctcatttttgtattttttggtaaagatggagttgcccagcctggtctcaaactgagctcaagggatccgcccgcctcagcttcccaaagtgctggggttacaggcatgagccaccacacccagcctttttcttctactttcagattggatggtgtttcagaaaacaagcctctattcaaataatattttactataattcttgttaaaaatactgtatactaagctgggcacaagtggtcacgcttgtaattccagcactttgggagaccaaggcagcggatcacgaggtcaggagatcacgaccatcctggccaacatgttgaaaccccgtctctactaaaaatac

SEQ ID NO: 258378 - DNA, 343 bp, Homo sapiens
gtgagactcagggaagggagaggaattggctgaattaatttaaaagaaaatctggccgagcactgtggatcacacctgtaatcccagcactttgggaggctgaggcaggtggatcacgaggtcaggagtttgagaccatcctggacaacatggtgaaagcccatctctactaaaaatgcagaaattagctgggcatggtggcacatgcctgtaatcccagctactcaggaggctgaggcaggagaatcccttgacccagggagtaggaggttgcagtgagctgagatcgcgccacagcactctagcctggtgacagagagagactccgtctcaaaaaaaaaaa

SEQ ID NO: 258379 - DNA, 701 bp, Homo sapiens
tgatactctttttttttatttgagaaacttgcttagtagaaactgttgtgtatgctactgaatgacactaggtccaaagtggataaacatttccttatagggtaacttatagcaaaaacaacattttctccctgttatctcagatgctggtttcaacattcaggatggtctatatttacatttttagcacagaacagaatttgataaaaacaaacttcttttttatattctatttttattgagttagaattttcatacagtgaagtgcacagatcttaagtgtatgtacaatttaataagtttgataaatatatattcctgtgtaagtatcattacagtcaagataaagaacattttctcattcctacttctatcctccccatccgctataggcaaacattttttcgctttttctcagcataaattagtgttgtctgttctagggcttcctataaatacaaacgtatgcagtgttttatgtctaacttcttttgcccaacattatgctttccaggttcattcatatttttggatatatcagtagttttatgagtttgtgggatctgtaagttaattttttttcaccaaatgtggaaaatttttaaccattatttcaagtatttttttgttatccatttctccttcctatattttttgaaactccaattgcatatggtcagactatttgatattgtcactga

SEQ ID NO: 258380 - DNA, 672 bp, Homo sapiens
gtcagaagtagtgatggagtaaatcatataataaaatcttcaagaaatgaataaggctggtctggggattagttagatgactacaacaaactgggttagtgggtaatctgttgacataaacttcaaaagaaatcaggggcttggaaggaggaaggaagaagaaacaaaggtctgaaggtagcaagaagaatcaggaaagacaattatcctaactccagaccaagtagtaagagagacatgtgagagaaaaccaccactgtctgagaagactctaagtgtccttaatggagagccagattttgttagagaaacagtgaaggaaatcctctgaggagaggttgagtaaaaaggggatttttttttttaatgactgactgtgctccagagagtggagaagaatgaattgggagctgaggaggaatggtagatggaggctaattacaggatattccaagatgcttgagaatcaacatccacatgatgagatgacctgggtatcttgggtttcttgtgtgactggcagaaattcatatatagaatataagggggttaatattggcattctctagggtggtggaagtgtctgttgtatcgtgtggggaagaaatcaccttgacaggaaaacatggagctcaacacatcacttattcagtcacaaatgacattgaggtc

SEQ ID NO: 258381 - DNA, 501 bp, Homo sapiens
actgttggagtacagcaagtagagaatgatatggctagacatggtgccagattcttgattagattttagttctctagttgtatttgaattaaagtaggaaagctattattacgtggaagactttttacaatttacatattacagacagtggtagtaaaaaaaaaacgagattaatacatatttattagcaatatatattctactttcaagggaaaaattcacataatggaaaaatatgattgaaaccttgtgaaacaaatatgacaaatatataatactttctgttacatcttagcaagtggatgatgattgatgactatgaatgacaaggactatttatatttgaaacaaaaataggaatcttcttttttatctaagaaattgatggactactgtggagagctaaactaccattacaacaaaataagaagattttactaaaggaattgttgcataaggtcaagaaatttgaccttcgtattctaaatggtacatgcattg

SEQ ID NO: 258382 - DNA, 361 bp, Homo sapiens
acacttatcatattcagactgcaggtttcaaatgttgattctgccacttcacacttaccggctgtgtaaccttaggcaagttttatgtcccttttgtcctccagttttctcatctgtaaaatacaaatataacatatctcatagggttattctgaggttcaaatgagttcctgtgtgtgaagtgctttgaataatacctggcatacagtggtatatgagctaactctcactactgctaccatgctacatttcttgcagttttgttggagaaataaatatgatatatatatatatcaaaattctcagcatagcactggatgcatgactgtcatccaataaattgaaattattactgaagcaa

SEQ ID NO: 258383 - DNA, 728 bp, Homo sapiens
atgtgaaataataattaaggtagatagaatatttggatttccaataacacaagttcctaagtatacgtcagaaggtagcaagaccaagaacatatttttttagcaagagactaacaatttaatcccaggcacaaataacagtaaactgattgctagaagaagctatgatgtttagatataaacaaagtctaaaagataggaatagtcatatttactgttaccctaagaataggcctctcctaacagagaatgaacagaagccagtaagtttccccgtttctactaggacatatttcaagtttggtttattttgtataaagtaaaagaatgtgaaggagtctcaaacacaacataagaataaaactgtattacaaagccctaaatattcccttggattaattcactatattatatttattatgtatgccttatctacttccaaagaatattttttttctttttgtagcttaacggctaattttattttattatactttaagttctagggtacatgtgcacaatgtacaggtttcttacatatgtatacatgtgccatgttggtgtgctgcacccattaactcgtcatttacattaggtatatctcctaatgctttccctcccccctcccccgaccccacgacaggccctggtgtgtgatgttccccttcctgtgtccaagtgttctcactgttcaattcccacctatgagtgagaacatgcagtgtttg

SEQ ID NO: 258384 - DNA, 680 bp, Homo sapiens
gtgaatgtttctccctcattcctgaaacaacagatagagctgttgaagtttacaacgtcccccaaggcatttctgtgtttctgcctttaatctagggcccaagtgaccacccacaagaatgccccgaacactcactgcctcaggatgcgtcctgcaatttacattcccgtggtgcctctgccttcaccccacgctggtgcccccgcctccactccagccgtctctctggccacccctgccccctcgcttctctccatcatgccaaaaagtgccctcgtcctctgacggtggaagaggggattcagttaggagtcgggatggcctatgtgatttttgtacactattccagaataggtgtgtggttgctttaaaaatcaaaagaaatgtgtcttccaaatctttgaagccctttgatttcaggaagctgtggaccgtgtttagcctgtggctctgtgtgccccttggctgctgctgctgcttactcctgagggtgaagttgctaacataagaaacgagtaatttggatttgcgcttcttggtaaaaacccctttccattaacctgtaaaactctagagggcaggggatctctcacattgaatctggtggtcttgtgagaatgcctggaaaatagtaggcattctccaatgattgttgttggattagtgtcattgcttaaaga

SEQ ID NO: 258385 - DNA, 251 bp, Homo sapiens
cctcatatggtggagatacacacacacacacacacacacacacgagagagagagagcgagagcatgagctctctggtctcgtcttataaaggcactaattccatcatgaggacctcacccccatgccctcatctaaacccaatcacctcccaaaggccctatctctaatgccatcacattgagggttagggcttcaatatatgattttggggggacacaattcagtccacagcactccccaattatcaaca

SEQ ID NO: 258386 - DNA, 365 bp, Homo sapiens
atgttttttaaaaatagtaatttttaaagacaacagcaataaagaatgttaaatattgagaatttaatgtagcaaattagaagttcatctaaagaattaaaagacagtttgatggtggtggggcgtggtgcctcacacctgtgatcctggctctttgggaggctgaagcgggtggatcatttggggtcaggagttcaagaccaacctggccaacatgatgaaaccctgtgtctactaaaaatacaaaaattagccaggcatggtggaggacacctgtagtcccagctactcaggaggctgaggcaggagaatcgcttgaacctgggaggcagaggtttcagtgagctgagatcatgccactgcac

SEQ ID NO: 258387 - DNA, 437 bp, Homo sapiens
tcccccagctccttgcacttcctgggtgtagcgacgcccccgccaccccgcttctgcttgctctccatgggttgtacccactgcctaaccagtcccagtgagatgaactgggtacctcagttggaagtgcagaaatcacccaccttttgcgttggtctcactgggagctgcagactgaggctgtttctgttcagccatcttggcccctccttatgcctctagatatctacccaaatgagttgaaaacatgttcacacaaaaagctgcacttgaatgtttatagcagttttactcataattgcaaataattggaagcaaactagaggtctttttagagtttttctctgtattgacctttctctctatgccttctgatgtgcagctaaaactatataaaaatataataaaattaaaggacttaaaaggtaggaaccaaa

SEQ ID NO: 258388 - DNA, 405 bp, Homo sapiens
atagccttttctactcaccaaatccacccaactttttggaaaaaaaaaacttgcattttcaggttgactctcttgcaggaagggtcgggagcctatggtggcaggacagagagatgtgtgtctcagtgcactggattgaatagtggccccccaaaatgtttatccatgtaggatctcatgtgaccttatttggaaacagggtcattgcagatgtagttagtgaagatgaggtcatgctggagtaggtgggcccctaatccagtgactggggtccttatgagaaggccatgtgcagaccccaagagagacaggaggagaaggccacgcagtgaagaaaacagaggctggagtgacgcatccacaagcccacgggtgacaagcacagccggagccatccgaagccag

SEQ ID NO: 258389 - DNA, 1013 bp, Homo sapiens
acagcttgggtctctccaccctcaggacctagcacgagcgcagccacctcccagctggtcccaggctctgccctctatcttggcatccagatttggagagcagtgccagctcaaggcaaaggccactatctctcttcagagcccttgcaccctcttggagatggcttgagcgagtggctccatctgacctaaaggacgcactggtcctgcagccccatctgcccacagcctgcctcctgtgtggcctctgcagtgagctctgcgcagtgggctcttctccaggcacctggaggcccactccccggctgtcccggaatcctcttctctgacctcggccctccgattttccccagaacgccatccatgaggccctgcccaacgtccctgcggttctcctgcctctctggctcctggcctctcgccaggcactcctctgccttgccccagccgtccacttgctccctcacttgtgcctgcaggaggccggcacagagcagaggactgcatggagtccacccctggggctccacctcctgtcctgtcctggattcacacttctccttctcctgcctcctgctgctgggccacagcaacaacagcaaaagttagctagattccgagatgcagagttcaattctgtagtcgttgaactcaaaatgaattgaacccactcttggtgcaccagccaaggccagcagggaggcaggttttccaggcggctgcagggctgcgaatttttgcatgtgactagagagctgggaaggggcccacccaggagtgttggtgtgtaaggaagatgcaaggttggatttgtaatgacaactcggcctttcttcagacatggccaagcccatcagcatgggcatggccagcccctgagcgggggacagtcctcccgctcagggtctgggtggtatattaactgaaaggggtccacagcaggctcacattgtttccttgatgaaggacaggctgcatctaccgaaggccatcagcactatgtgcctgtcatt

SEQ ID NO: 258390 - DNA, 620 bp, Homo sapiens
gctgagggagaaggcgcggggccggggagtgtggttggcctattagaagtaaggattgatagggcctgggtggagatcagctgggagtgaaggggggacgggcttgggtttgaaggtgaaggtctctggagaactggggacacgtggatctggagtaagaggcacctactgaaaccggaaggtggctgagaaggttttatgtgaggtgtggacgggaggctattggactagaaggcattagttggtctgttaggacaaagtatacaagcagcaaacgcggtagatttatgtgtggtaggtgaaggctgtgaatcttttatgagtagttgagcaagaacagttgtctgattctgcggtgtcggagagtggagggtctcaggtagtgtcttggtcaggtttgaaggttaatttactgctagtggagggccaaatactcaaaagagtttttaattctcactactggggctgatcctcctcctacactccacccctcctgccatccctgtgacagttcatctcgttttgcctcagcagcacaagaactcactccctccgaagtaatggcatacatattgtttgcttttgactagatggcagtcaggaatcccttaattctttat

SEQ ID NO: 258391 - DNA, 437 bp, Homo sapiens
gctgagggagaaggcgcggggccggggagtgtggttggcctattagaagtaaggattgatagggcctgggtggagatcagctgggagtgaaggggggacgggcttgggtttgaaggtgaaggtctctggagaactggggacacgtggatctggagtaagaggcacctactgaaaccggaaggtggctgagaaggttttatgtgaggtgtggacgggaggctattggactagaaggcattagttggtctgttaggacaaagtatacaagcagcaaacgcggtagatttatgtgtggtaggtgaaggctgtgaatcttttatgagtagttgagcaagaacagttgtctgattctgcggtgtcggagagtggagggtctcaggtagtgtcttggtcaggctggagtgcagtggcgagatcatagctcgttccagcctcaa

SEQ ID NO: 258392 - DNA, 3625 bp, Homo sapiens
  misc_feature (2689)..(2689): n is a, c, g, or t
  misc_feature (2718)..(2718): n is a, c, g, or t
tcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaaatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaattncttacatattaatttcctttattgtatgnctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaacaaaaaacaaaattacccagtagtggtggtgcaagcctagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgt

SEQ ID NO: 258393 - DNA, 493 bp, Homo sapiens
caatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgt

SEQ ID NO: 258394 - DNA, 6483 bp, Homo sapiens
attgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccggatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcctcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcggatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacacccttttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagcgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggatgatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgccgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtataggcactataatttgggactctcagctccttggctttaccttcagtgacatgtttatccgcatctccacccgccttccctccaagtacctctatggcttcggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgacggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatgcaccctgttgccatatctgtataccttgatgcataaggcccacacggagggcgtcactgttgtgcggcctctgctccatgaatttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagccgccagaaattcatgggcttcaaaattgccttggatgatgaaggaactgctgggggctggctcttctgggatgatgggcaaagcattgatacctatgggaaaggactctattacttggccagcttttctgccagccagaatacgatgcaaagccatataattttcaacaattacatcactggtacaaatcctttgaaactgggctacattgaaatctggggagtgggcagtgtccccgttaccagtgccagcatctctgtgagtggcatggtcataacaccctccttcaacaatgaccccacgacacaggtattaagcatcgatgtgactgacagaaacatcagcctacataattttacttcattgacgtggataagcactctgtgaatttttacagcaagattctaactaactatgaatgactttgaaactacttatacttcatactcataaaaattattgtgtgttgctaatttgttcatacccactattggtgaaatatttctgttaattttgttatatgttttttgtgtgaaccctaaaggttaaaccttagccctgtgggataggcagttagggaggtgtggaaaatctatgcattaccttaatgtctctgtgtggttagtatggtagtgactgttcatcatatgacatttactgaagatgaactgggtccatgatgaagtgtgtgtatgtccacgtttgtaatcatagaatggaccccattcttttgttaaatacacaagagaaagctttctgtgacagttccaggtcttgaagctaatcagcatctcaagaaagtatccagaaagaacatctgctagttggttataggcggtgggaggaataatatacctaattggttataggtggggggagcatgataagcaaagaaaaggcaaacacaaggaaagatcagatgaaacagaagatgatagtaaaagtgatcctaagtaagaacataatgtaaaattgtcagcagcctcatggggaggaaaaaggaagagtcaactcacttgaagaagagggtcttgagaaatccttagcataaagggctactggtgagattgagatctgagcaggcaaagctcaaaagagagtttggaggttaaaaataatttatttttgcagtagtgtgctttgaaatgtgtaaatcttatttctaatgtatacaaccacatttcacataaaaatatgcaatttatatgccagataaaaataaaacaagtgaatttgcaagtg

SEQ ID NO: 258395 - DNA, 2905 bp, Homo sapiens
actgggttaacactgggaaataaaaacttcccacccacttcttgcaggaggctgtgtggttaaatcctgttacattatacttcagctcttaccatggccttgtcattgggttgaactggagctgtattttagattttgccaacaataacaagcgctgccaagtacttcagctgagatcacccaaataatactctactagcaaaagctttgcgtggcgttctaaccatcagaaactgagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccggatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcctcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcggatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacacccttttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagcgatggcatatgtgcctgatgctgtctggtatgactacgagactgtaagtagctttgacttttcttctactccttaagactgtagctgcagctgcatagacaagctacctttctggagagagaaacatccatctacatgctgaggagtagtttttagtgttttctgtaatttcatagcagaacctgggtaaagttaacctaaaccgttaacatcagtcatgatgaaatgtgaaaaaataccttcatatactttatttagcaataagataggctgacatagtatctcataaattaatattggaggaactgatggacaatgtgagcttggtcaggaatca

SEQ ID NO: 258396 - DNA, 5464 bp, Homo sapiens
actgggttaacactgggaaataaaaacttcccacccacttcttgcaggaggctgtgtggttaaatcctgttacattatacttcagctcttaccatggccttgtcattgggttgaactggagctgtattttagattttgccaacaataacaagcgctgccaagtacttcagctgagatcacccaaataatactctactagcaaaagctttgcgtggcgttctaaccatcagaaactgagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccggatcctgggacaactggtaccccagatcctggaacaactggtaccacacatgctaggacaacgggtcccccagatcctggaacaactggtaccactcctgtttctgctgaatgtccagtggtaaatgaattggaacgaattaattgcatccctgaccagccgccaacaaaggccacatgtgaccaacgtggctgttgctggaatccccagggagctgtaagtgttccctggtgctactattccaagaatcatagctaccatgtagagggcaaccttgtcaacacaaatgcaggattcacagcccggttgaaaaatctgccttcctcaccagtgtttggaagcaatgttgacaatgttcttctcacagcagaatatcagacatctaatcgtttccactttaagttgactgaccaaaccaataacaggtttgaagtgccccacgaacacgtgcagtccttcagtggaaatgctgctgcttctttgacctaccaagttgaaatctccagacagccatttagcatcaaagtgaccagaagaagcaacaatcgtgttttgtttgactcgagcattgggcccctactgtttgctgaccagttcttgcagctctccactcgactgcctagcactaacgtgtatggcctgggagagcatgtgcaccagcagtatcggcatgatatgaattggaagacctggcccatatttaacagagacacaactcccaatggaaacggaactaatttgtatggtgcgcagacattcttcttgtgccttgaagatgctagtggattgtcctttggggtgtttctgatgaacagcaatgccatggaggttgtccttcagcctgcgccagccatcacttaccgcaccattgggggcattctcgacttctatgtgttcttgggaaacactccagagcaagttgttcaagaatatctagagctcattgggcggccagcccttccctcctactgggcgcttggatttcacctcagtcgttacgaatatggaaccttagacaacatgagggaagtcgtggagagaaatcgcgcagcacagctcccttatgatgttcagcatgctgatattgattatatggatgagagaagggacttcacttatgattcagtggattttaaaggcttccctgaatttgtcaacgagttacacaataatggacagaagcttgtcatcattgtggatccagccatctccaacaactcttcctcaagtaaaccctatggcccatatgacaggggttcggatatgaagatatgggtgaatagttcagatggagtgactccactcattggggaggtctggcctggacaaactgtgtttcctgattataccaatcccaactgtgctgtttggtggacaaaggaatttgagctttttcacaatcaagtagagtttgatggaatctggattgatatgaatgaagtctccaactttgttgatggttcggtctcaggatgttccacaaacaacctaaataatcccccattcactcccagaatcctggatgggtacctgttctgcaagactctctgtatggatgcagtgcagcactggggcaagcagtatgacattcacaatctgtatggctactccatggcggtcgccacagcagaagctgccaagactgtgttccctaataagagaagcttcattctgacccgttctacctttgcgggctctggcaagtttgcagcacattggttaggagacaacactgccacctgggatgacctgagatggtccatccctggcgtgcttgagttcaacctttttggcatcccaatggtgggtcctgacatatgtggctttgctttggacacccctgaggagctctgtaggcggtggatgcagttgggtgcattttatccgttttctagaaatcacaatggccaaggctacaaggaccaggatcctgcctcctttggagctgactccctgctgttgaattcctccaggcactaccttaacatccgctatactctattgccctacctatacacccttttcttccgtgctcacagccgaggggacacggtggccaggccccttttgcatgagttctacgaggacaacagcacttgggatgtgcaccaacagttcttatgggggcccggcctcctcatcactccagttctggatgaaggtgcagagaaagcgatggcatatgtgcctgatgctgtctggtatgactacgagactgggagccaagtgagatggaggaagcaaaaagtcgagatggaacttcctggagacaaaattggacttcaccttcgaggaggctacatcttccccacacagcagccaaatacaaccactctggccagtcgaaagaaccctcttggtcttatcattgccctagatgagaacaaagaagcaaaaggagaacttttctgggatgatggggaaacgaaggatactgtggccaataaagtgtatcttttatgtgagttttctgtcactcaaaaccgcttggaggtgaatatttcacaatcaacctacaaggaccccaataatttagcatttaatgagattaaaattcttgggacggaggaacctagcaatgttacagtgaaacacaatggtgtcccaagtcagacttctcctacagtcacttatgattctaacctgaaggttgccattatcacagatattgatcttctcctgggagaagcatacacagtggaatggagcataaagataagggatgaagaaaaaatagactgttaccctgatgagaatggtgcttctgccgaaaactgcactgcccgtggctgtatctgggaggcatccaattcttctggagtccctttttgctattttgtcaacgacctatactctgtcagtgatgttcagtataattcccatggggccacagctgacatctccttaaagtcttccgtttatgccaatgccttcccctccacacccgtgaacccccttcgcctggatgtcacttaccataagaatgaaatgccgcagttcaagatttatgatcccaacaagaatcggtatgaagttccagtccctctgaacatacccagcatgccatccagcacccctgagggtcaactctatgatgtgctcattaagaagaatccatttgggattgaaattcgccggaagagtataggcactataatttgggactctcagctccttggctttaccttcagtgacatgtttatccgcatctccacccgccttccctccaagtacctctatggcttcggggaaactgagcacaggtcctataggagagacttggagtggcacacttgggggatgttctcccgagaccagcccccagggtacaagaagaattcctatggtgtccacccctactacatggggctggaggaggacggcagtgcccatggagtgctcctgctgaacagcaatgccatggatgtgacgttccagcccctgcctgccttgacataccgcaccacagggggagttctggacttttatgtgttcttggggccgactccagagcttgtcacccagcagtacactgagttgattggccggcctgtgatggtaccttactggtctttggggttccagctgtgtcgctatggctaccagaatgactctgagatcgccagcttgtatgatgagatggtggctgcccagatcccttatgatgtgcagtactcagacatcgactacatggagcggcagctggacttcaccctcagccccaagtttgctgggtttccagctctgatcaatcgcatgaaggctgatgggatgcgggtcatcctcattctggatccagccatttctggcaatgagacacagccttatcctgccttcactcggggcgtggaggatgacgtcttcatcaaatacccaaatgatggagacattgtctggggaaaggtctggcctgattttcctgatgttgttgtgaatgggtctctagactgggacagccaagtggagctatatcgagcttatgtggccttcccagactttttccgtaattcaactgccaagtggtggaagagggaaatagaagaactatacaacaatccacagaatccagagaggagcttgaagtttgatggcatgtggattgatatgaatgaaccatcaagcttcgtgaatggggcagtttctccaggctgcagggacgcctctctgaaccaccctccctacatgccacatttggagtccagggacaggggcctgagcagcaagaccctttgtatggagagtcagcagatcctcccagacggctccctggtgcagcactacaacgtgcacaacctgtatgggtggtcccagaccagacccacatacgaagccgtgcaggaggtgacgggacagcgaggggtcgtcatcacccgctccacatttccctcttctggccgctgggcaggacattggctgggagacaacacggccgcatgggatcagctgaagaagtctatcattggcatgacggagttcagcctcttcggcatatcctatacgggagcagatatctgtgggttctttcaagatgctgaatatgagatgtgtgttcgctggatgcagctgggggccttttaccccttctcaagaaaccacaacaccattgggaccaggagacaagaccctgtgtcctgggatgttgcttttgtgaatatttccagaactgtcctgcagaccagatgcaccctgttgccatatctgtataccttgatgcataaggcccacacggagggcgtcactgttgtgcggcctctgctccatgaatttgtgtcagaccaggtgacatgggacatagacagtcagttcctgctgggcccagccttcctggtcagccctgtcctggagcgtaatgccagaaatgtcactgcatatttccctagagcccgctggtatgattactacacgggtgtggatattaatgcaagaggagagtggaagaccttgccagcccctcttgaccacattaatcttcatgtccgtgggggctacatcctgccctggcaagagcctgcactgaacacccacttaagtcgaaagaaccctcttggtcttattattgccctagatgaa

SEQ ID NO: 258397 - DNA, 535 bp, Homo sapiens
cccaatagaagaaaaatgtgctctggcagcactgtcatgaaaaacaaagaaggcgactcctcctacacagcagagttgttcagaaagtaccacgctgcactggcaataatcaattttaatgattaaggctaatgtgttttgcataaaagacaagaataaattaaagcaaagcccacaaatgacagggtgacaaacactgtgtcttgaaaaagcaccaaacaatctattattgaacgtctaatttttccccacactgtttatctttctttatcaatgtttccagcaaggcactcacatttttatacctgtattttgtaaagtaaaattatccaaaaaattgtggcatttaggggagtcagagccaggttgtgggagtatggggaaaaaaagatagctggtctcacggcttcacatccactggctaaagcagtggttctcaataggagtgggttggattttgaccccagaagatatttggcaatgtctggagacatttttggttgttagaactggggggtccctattggcatctagt

SEQ ID NO: 258398 - DNA, 494 bp, Homo sapiens
cacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctc

SEQ ID NO: 258399 - DNA, 857 bp, Homo sapiens
ctccagagaatggatcccacaatttgtggccacgtctcactctgagctcagtgcctggacttggctgtggccaggaaatggacggaagatgtggggtgagctcatgtgacatgagctttaggaaaagggccagaaaaaagctttcaggaacagaagacaaccacagctgcgtagcaggtaacagccatctaaatggcgtttttgttttgtttgtggattgcttcattggttggttgtgctcctaactacatgctcttgttgagctaaagaaaaactggcccttccagaatggaacaggctgttttgcttctttgacaccatctatgtattaaacggagggaatgatctttaactgtttgctcatcccttcgcctcctgaatcatcttgctctcaaatttacttgtatttgtggttttacagtgtaaagcgtgctctattttggctacaagtactacattctataccatattggaaatgttcttgagcactatcatatacggggggattcgcagtcagggcaactcccaatgggagaaagaaagacacatcttttgcctgtcagtactaggagctagcatttcacagtgcttggaagttaaccaaactttgatctttttgtttgaagctcgtttagcctccacttcagtgcaatgaggtagttgctatccctattttatagatgtgaaaacagaggctcaatgaagacagataggctgctcagacataggctttggacttgagttctcaccacacgcccaggtaaagaagagcctcctgggtctgcccaatctgtggcatctgctgtcaggagaaaaacaaaactccattttggtctgcaaaaagaaaccagtgggaa

SEQ ID NO: 258400 - DNA, 1124 bp, Homo sapiens
gtggtcatggaatagagtaagccactgaagtcgatggcttgtcccagtcctcactatcagaactagtctaagaatttgaagtcaatgtgttatttttactctataaagtaaaagtagaaagtcagtttcagtacttaataaatatgattattctatgctgatagtaatcttgagaaactatagtttttatacttctattcccaaatgtaaaaactcacaatttttctgcatatgattttaatttggttcccttaagccaaaaaacatgacaacaattattgctactcacccccaagaagaaagtgtggaaaggtttgtgggaaattgtttaaaaaaaaaaaaaaaaagacgtttaggataaccaggtactttcaagttcctcattagtttgtgagaagtcctgatggttacatttcactgaaacttgaaaaattaagcagaatacaggagcaaatagcatgaggcgttctctttctggactgtttatctggaaaaactaaaaatgctagagaactcaaaataacaacttttaatgtctgagctgactagaatgtaatagaattttccagaagtcaaaaaggaagtaggagtagtaatctgggaaaataagtcagcactataggctagagttattctggaagaatctgtaattgtctctaacctagtgcttgagagccatatcctcatggaaagaattaactaggaaaagtcctttccacaaaagcagagggcaaggaaacttgcttgtctggctgtatggtaagggaacaagatttctgagaatttgtaatcataggcttctgatacaggtctttagcctaagttcatagaaccagtgtgccctgaaaaactccagaccaagaagaacttagttctttagtgtaaagtgctcatggcttggtagtatcccaaggaacctggaaaaaagggcttctccaaagatatcatcaacccaggcctcagatgccacacataaaagaatattaactcataataaaattaaatcagaaaaccatgagaaaaagcacaatgagcaaaaaggcaatagaaacaataggtagtcataccagcaaaggcttcagttattggaattatgagatgtagaatataaaatactatctttg

SEQ ID NO: 258401 - DNA, 1245 bp, Homo sapiens
gtggtcatggaatagagtaagccactgaagtcgatggcttgtcccagtcctcactatcagaactagtctaagaatttgaagtcaatgtgttatttttactctataaagtaaaagtagaaagtcagtttcagtacttaataaatatgattattctatgctgatagtaatcttgagaaactatagtttttatacttctattcccaaatgtaaaaactcacaatttttctgcatatgattttaatttggttcccttaagccaaaaaacatgacaacaattattgctactcacccccaagaagaaagtgtggaaaggtttgtgggaaattgtttaaaaaaaaaaaaaaaaagacgtttaggataaccaggtactttcaagttcctcattagtttgtgagaagtcctgatggttacatttcactgaaacttgaaaaattaagcagaatacaggagcaaatagcatgaggcgttctctttctggactgtttatctggaaaaactaaaaatgctagagaactcaaaataacaacttttaatgtctgagctgactagaatgtaatagaattttccagaagtcaaaaaggaagtaggagtagtaatctgggaaaataagtcagcactataggctagagttattctggaagaatctgtaattgtctctaacctagtgcttgagagccatatcctcatggaaagaattaactaggaaaagtcctttccacaaaagcagagggcaaggaaacttgcttgtctggctgtatggtaagggaacaagatttctgagaatttgtaatcataggcttctgatacaggtctttagcctaagttcatagaaccagtgtgccctgaaaaactccagaccaagaagaacttagttctttagtgtaaagtgctcatggcttggtagtatcccaaggaacctggaaaaaagggcttctccaaagatatcatcaacccaggcctcagatgccacacatggccaggtctggtggctcacgcctgtaatcccagcactttgggaagctgaggtgggcagatcacgaagtctggagttcgagaccagcctggccaatatggtgaccccgtttctactaaaaatacaaaaactagctgggaatggtggcgagtgcctataatcccagctactcaggaggatgaggcaggagaattgcttgaatcccagaggcgaagttgcagtgagctgagatcgtgccattacactccaacccaggcaacagagtgagacgc

SEQ ID NO: 258402 - DNA, 492 bp, Homo sapiens
agagatggaagttggaatggacaagcctgccctctcatcggctctccatggctctgtcctcaggctgtttctgcaatttgacatgaggcctggccccagggaaaccagtggggcctcatctcctccctgtgctgctctgagatggagtcttctcagggtcagtccagctctggagcccctctccagctcggtcaccaaagctgtctggtcccagggcggtgctgagtgacaggcacaccagccagtccaattggccatttcatacccaatgcatgtgactgataaagagataacaccctgtctccaagacacaggctttacataaacagctttaatgacctcttcacctagagacaagactccttagtggtggaacctcaggcatccgtgcaggatgtaagaaagctcccgtatatacatgaactgagaagtgtgtagaagaataaatactgtaataggtaataaaatgtatgtatttttatttatatgcta

SEQ ID NO: 258403 - DNA, 597 bp, Homo sapiens
gatgtagatggaaagaatggaggtttagtaactcaaatgcatggatcatgtagctggagatacacccaagcctcagaattagtaagaaaatattttgaaacagtctatttgaattcaagatttttgcagtaccagttttctgtcattgttatgcactaaattgtgtcaccacctcaaaccatatgttgaaaccctaacccccaatatgactgtatttggaggcaggactgttcaagaggtaattaaggttaaatgaggtcataaatgtagggccctaatccaatagtactggtgttcttgtatgaagaggaagagatgccagagctttctctacctttgtatgtgcacagtggaaaagccacttgagttcattgtgagaaggtgactgtatataagcctggagagacctcaccagaaaccaaccctactggcaccttgatcttggacttccagcctccataactggagaaatggatggcttaaactgtatttctgttgtggcttaaactacatttcagttgtttaagccacccagtctgtagtatttttatggtatttattatagtattaaagtattatgatattaaattattatgg

SEQ ID NO: 258404 - DNA, 1609 bp, Homo sapiens
ctgccctctggaccctgcggaccccagccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccggacccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggctctgcggcggtgtctgcgccggtgctcgccctgcaccgcctgtcacccgggccgcgcgcctactgcagtgaggccttccccagccgcgccctggagcgcgccttcgcactgtacaacctgctggcgctgtacctgctgccgctgctcgccacctgcgcctgctatgcggccatgctgcgccacctgggccgggtcgccgtgcgccccgcgcccgccgatagcgccctgcaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgcaccgcctggggtcccacccggcccccgccagggcgcagaagccagggagcagtgggctggccgcgcgcgggctgtgcgtcctgggggaggacaacgcccctctctgagcggacccggtgggaatccgagcggctccctcgggagcggggactgctggaacagcggctattcttctgttattagtatttttcttactgtccaagatcaactgtggaaatattttggtctcttgtgacgttcggtgcagtttcgttgtgaagtttgctattgatattgaaattatgacttctgtgtttcctgaaattaaacatgtgtcaacacaggactttctggatcattccagaaagtgtcagacgttttctcattgaaaaata

SEQ ID NO: 258405 - DNA, 139 bp, Homo sapiens
gaggccaaccatccaagagtcccagtggatggtgcagaggagtgaagtgcagcgctcacacagcttgaggtgtgaatgctcaccctgttttgtgccctcagacaagctgcttcactgtctaaacattggtgtcctcttc

SEQ ID NO: 258406 - DNA, 321 bp, Homo sapiens
tgcagtttggttgactctgccactccaacctgctggctttggagaatacaggtgatccaggtgaggaaggatcccacccaatgcagcccacctgctctaccaaaaagcagccaggctgcttctttgagaaggtccctgatcccattcctcctgactgggcgagacctcccaatgagggtctccagccacctccaacagttgcatgtgggctggcaacaagttagtacccccacaggatggagtttctagaggaaggcacaggctgccatctttgctgtttcatggcctttgctggtgatacttccacgtacgggagaaacc

SEQ ID NO: 258407 - DNA, 709 bp, Homo sapiens
gaggaggtaaggttgctggggaggcaaaacagaacatgacgaagccacactcgggaataacattgaggagtgtctacatttgattgcctggagaaagaggaaaaaagaaggaaaactgggtgataatgttaccaaaatagcaggggtgtggtctaggtcctgctgcttgctgcacagaaagtcaatcactgagacaatgagtactgccagggaagaaggctttaattgggtgctgtagctgaggagatgagagatcacaatgaaatgattaaaaggataactaaaggaaatgtatagaagaatgaaaaggttgagtcaggggcacagcatagtaacatgtaggaagagaggatatagacattacattgcctggggacatctctttccctctctaggccactagcataggttcaaaacagagactaaattgcaatgcttatattctgtgtagactaaagactgaaaaagtaatggagctttactaaaagatgggtttcaaatgagagagtcagatgaaagtgcaagggatttccagcacctatgatggtaccatagttgtagatggcaggaaagcaaggagcagaagctttcaagtcgagtgcacagtcattttatgagaaggtgcaaggaaatgatgagggagtttacagaacccaactgtctcacaatttgcattgtatgggcgcccttatttagtttgtggagttct

SEQ ID NO: 258408 - DNA, 259 bp, Homo sapiens
tgaaaccttgtctctactaaaaaaaaaaaaaaaaaaaaaaagagttgagagagtggctgcccttggtgaaggggcagtgatttggagggggcttctggggacttctcgggggatggacaagttctatttcttgagcttgatgctggttatgtgggtggattgggtttgtaaaatttcatgaaactgcaggcatgtttatatgggtacttttcagtatttatgtggtacttcaataaaaagctgtgaggccaggtggtgg

SEQ ID NO: 258409 - DNA, 484 bp, Homo sapiens
agggaagcctattaaagactcagtacctagagtttttactggaggccagtcacttaggtaccctctgcctaggatatacaaacttccagatttccagaaggaaagtggatatgcagcataaaccacattatttgcacagacagtttaggcaaattgagccagtcttaccatttagagaatggtggatcactcctgaaagtcaggtctgctaaaggccaatgtttcaaacaggtcttcctatatttaattgacacagtcctgattaactgtttactacacaccaggttatcttagaatagttatcttactttcttcacacttgtggaagaagagattataattaaaattaaaatgcactaatttaaagccctgatatattcaattagctttggtatctcaaaaattttggttgctaaccatgatttctcattttgagttggtgttatatcatgtgcccttaaaataaaatgatgcaatataccta

SEQ ID NO: 258410 - DNA, 422 bp, Homo sapiens
atcagcttatcaatttctttttaaaacctaattttattgatagcgttcaatctttagaccaactagaagaaagctggtatctttataatagggagtctttcaacctaaaatatggtatgtccttccatttatttaagtcatctgtaacttccatcagcattttatagtttataatgtaaaagatcttgcacttcttctgctggatccattcctagatatatcacaacaaaaccaactccagtgaaaatattctctacatataagaaacaacttttcaaagccattctaagagatatatgctactttcatttttatgttatttggctaacactgcaaatctctcatgaagcacatctgcctgtattttaaaggctaccttttgatccttagggtaccttataagcatggtgggatggtgtaaa

SEQ ID NO: 258411 - DNA, 450 bp, Homo sapiens
cgcattatagaagtggtagagcaagcagagaaagagaaaggaggcagattgcttatttaaagaaataatagcagaaaactgcccaaatctggggaggaaaatgaacatccagatccacaattcccaaagaattccatgtaggttgaacataaagatgtcttcattgatctttttgtggttcataagcatgatgattgggttttcataccattgtgtaagatgtgcctttctcagaccttgccaaaacactggcacattacctgtctgatatgaaaattttttcactgagacacattgtgatcaaattttcaaaagttaatgacgaagaatttgaaagcagcagaggaaagcaacttgtcatgtacaagggagctcctataagactttcagcaggtttttcagcaaaccttgcaagccagaagagaatgggatgatatactcaaaatactg

SEQ ID NO: 258412 - DNA, 240 bp, Homo sapiens
cggcacgaggtgatgttgagcggcctatagtgacagtcacggagtggccagctttggtgtctgtgcttgttgcgtccttgcattaaattcggggtgcggtgggggaatgattgccaacattctggtaacgatgaaaagaaagcttcagcagttttcctgaaaacctgtaatgccattttccctgtaagaccaagagatggccttgtggtaccatgtgaaaaacaacgttcacgcttacta

SEQ ID NO: 258413 - DNA, 416 bp, Homo sapiens
gaggaggtagcacttgtttgagttaatgatttgcaccacatttttggggatggtgactttaatactttaattctgcaggagttcagatgtatagtggacagatctcatctctgtttgagacttagtcaaacgaaccaataaatatttattgagcatttactggtaccctgcattgtgctcaaaccccatgtcgatcatgagtaaagtataagtcatggcccggtatgtcagattgaacagtaagatggttagagggaacaatccacaaggtaatgtagaagtgtgagtaattcaggataaattgtttgggacagttactgagtgatactcactttagccattggagagatcaatttggtctagaagtctcaaaggcttcctggaggaggcgagaaagatgataaacaggaaaagcc

SEQ ID NO: 258414 - DNA, 1011 bp, Homo sapiens
acttaatataagtgtagtggcaatttccacagatgaaagaaaaccaagagaaagaatgatggagaagagatagtccaagaattttcaacttgaaaaaatgcacaagtgattcatgacactcagagaacagcaatcaagacaaataacaaaataaaacaataaaaacagaaatacttagacgtctaatattgcaacttctgaacacaaaaaaataaaaacacattgcttaaaagtagctagataaaaatggcacacctatacaaaggaaaagagaactacagcatatttctctacagaaaatatgcaatctgaaagaaaaatggaattaggttgttaaattctgaaacaaattgtcaacccggaattcaattccttaaaaagttatttttcagaagggaaggaaaattaagaaattttccgaaacacaaaatagagaatttcttgccagcagctccataaacaagaaatatttcaggataacttcaggcagaaaaaatatattaattataaaccaacttggatctaagtcaacaacaacagcaacaacaacaaaaacaaacaaacaaacaaacaaacagggtaatgaaacggcatatgaaagcaaatacaggaaggccatttttttttcttatttctaattactctgaaatacaactggctgcctaaagcaagagagtagtaaggtattgacttttagagcaaacataaaagtaacctgtatgacaacattaccaaaaaaataaataaataaaaggaatagattgaatatatgtatttgtaagatttttaactatacaaaaagtagtataatattctttaaaagcagacagattagttaaatgtgtattttaaatgtatattgtaaaccctacgagaattactaattttttaaaaagtaatataaataataaatcaatattatagataaaataaaataaaaatagtcaatttatataaaaaaagaaatataacagaaatgggaagaaaagaaatagtacatgaaaacaatag

SEQ ID NO: 258415 - DNA, 327 bp, Homo sapiens
ttgatgagatctgaagtgatgtaaataaataaggcttcctgatattgtataatgaaatgtatcaacatttgaaagacctgttatgaaatcatgcacaggcaaaggatccattcattcaaagtacaaaatacagtagtggatttttttttgtaggaaaatatacgtaacataaaatttaccattttaatgattttttttttttttttgagacagagtctcactctgtcaccaggctggagtgcagtggcatgaccttggctcactgcagcctccacctcctgggttcaagcaattctcctgcctcagcctcccaggtagctgggacta

SEQ ID NO: 258416 - DNA, 410 bp, Homo sapiens
gatcagattacatagtgatcaaaatctggtctgaactaacaatcagtctaccagagcctggggtaggtgctgagccccaggccccaccataccctgtaccctccattctctggttgcaatggcctgcttagccctctgtctctcctggactgagtgctctgggagtgagacagggatgaaaccctgtttgctgctgagcccaaaattagtgctgtgtttgagggaggcacatgtggtgtgcctagaggctgaatgagagggtctcttcaggacctccagacagtgagcccctaccgcagcaccatgcccagtccctatgggcacttggtaaatgggaatggaatggacacatgtgcccaggggtgactgttctaaggccgacggcagcgtctgtagggtccaccatctgc

SEQ ID NO: 258417 - DNA, 699 bp, Homo sapiens
gcctggtgcataacaccatgcacataactcaatactggacacacagtgacaggcacacaacactgggcgcacaaaggaagtatgcatgctaggcactcagcaggaacacaggacactagaaggcacacccagtcagcacatacagttggctttgagcaacgaagtgtgcgcagacgcagtgtcacccaccagcttagggctgaccgtggccagccgtgctccagatggcggccgccccgcggcgcagatcttggatgaaggcgacatggagcggggctgtcgccagccactggggctcagggggctcaggggcacttgcggcagccacacagcctgagcgctgctggctgtaactctgtgggatgcacgaggtttgcttccatcagtgccctctctgatgcacatgtgaatcgctctgagtctcttacgataacaaaaaattccgtagggtgtggcacgtgtaaacccgactcgtatttcttgctagagtatctttggcaaggtttcctgggttactgggtcagaagtcaaaggcaggtgactttgcaattgccaattatctccgcagggctacaccagagtgggtcaggggaagaatcagagatgggtcgtaggattgtatcgtcattaggtgcatgtgcccagaaagcaggaaacaaatctcccaaaaaagctctctcagcctgctcttcaaaaacc

SEQ ID NO: 258418 - DNA, 515 bp, Homo sapiens
gttgggcaaatactgaccgagctcctgctccatgctgggcactggggaccagagatgactccgacccaggccctggcctctaggagattgtcagtgaggtaggaggtagacacgtgcacagatgtcacagtgtcttccttgcccttttgtgcctggaccccagtttgtagccacctgtttctttgttcactgactgttctccccctttagattggaatctccatgaggcctgggcccatctgccctgttcgctggggtatccttagcccctcactcttgcttggcacgtagtgtatgttctgtattacagccttggaagggaaggaaggatggttgctgtttagtgatcactaagtgtggtccaggcactgttacaagctttctatgccctgcctccttggagccttacaaccctgtgcctcatgtatgtatcgtcacttgctgggggttgcaggagattgtttggcgatagaaacaagttgtagaactatataatgtgacctcattcctgttta

SEQ ID NO: 258419 - DNA, 1415 bp, Homo sapiens
tattgttttttataacaaagtggaagatttcaagaaaggacaactcactgtacacttgagaataatacctacagaggttcatactgaagagtagtctcaataatgtaaagaatttgacaagcatgatgctattgaaatagttctgtaaggaagtggtgttctttatacatcaattattacaaaaagcagtgaattgtaagtgtgaggtgtgtttacttagatgtgaagagttctccttactgctgtgatggaataacaagggtcagatttcctctcctgccttaaacaactggaagctatacaatacgtataataggtaatggtttttagacataggacaagcacaggtttgtgatcctcaggagactgcagacagagtgaggtgagcaccatggtttctcagcctgcccccgcacggcagttcctaggttgcagttcagggaagggaaacaataaatctcgctgaattgaagagacaggactggcagttggggaggccacagcagctagaatttccaggggaaagtactggagagatgggatccttctagatacagggctcaagaagtctgctgggagtcccctgagtcctttgacttagtactgacttgcactgaggccaggaaaagaagcactggaaagcagcaggctgaacaattcctggaactcatgcagggctgggaatagtttatgttctcagcagccagagtggaaacagagtggaaacacatggagcatcaggtagaattctcagaaaggttttgttttagtagtgcagctaattaactctagattaaaagctactctggacctacagtgtccggcatccaaaaaaactaatgtgttatgcaaagaagcaataaaatatgacttataaccaggagaaaaatcagtagaaacccagaaaagacagaggtgatggaattagtagacaaggatattaaaagagctattgtaaatataaagtagaggaaaacataagattgatgaaacctgaggtataagagatatttttactggccaaaatggaacttctagggatgaaatcaacttctgattttgttaaaatcccgagtggagagattagatacagaaaaagaagaaaaaatcaatgaacttgaagagtaagaataaaaactaccaaagtgatatacagagagaaaaaaagacttagagaagaggaagagaataggaaaaccattacagtagtgtaatatatgtttaactggagtcccagaaggagaggagaaaatgaagaggcatgaagaagtatttgaataaataatggctaaagattttccaaatctggtgaaaacaatacccccacatattcaagaagctcaaatgacctgaagtagaataaacataatttacatcacagcagtgcacctcagagtcacattcatgaaaagcac

SEQ ID NO: 258420 - DNA, 1245 bp, Homo sapiens
ctgcattctctctgactagaagcttctgttcctgacaccaaatgtgccaggttagcaaatgagcacaagatgtggccctgattctagttggtggggcaagggcctggttctcctgggctgagtgggggagtgtcctggcagcagcgagtgacctgggcagtggccaggtgggtgcgatgactctgatgcctcactcagtctctgggcaatcatcatctttgcctctagccaccgtagataaggtgtgaagggactgctgtttgcaatgggcttaccatccaaatatcccaaaggctttgaccagcaaccaagtaaaatcagtaattgaggagagcagggcacaaaggggctgcagtttgggagctcctgaagaaatggctcagatattgagtcagagaaataaaaagtaggatcagttagcaattctaactgcccttccttctgacccctcataagaggagtgtggtgagggaggggactgggtaggggtcatcccaggaggaggggtttacattggaaccagttcaggttcggtgcatctttcctcttcggttttacagtggcttccgtgggatcgtcaatttcttgttcttagagtttcgggtgtttttctccagtcttgttactgtagactgtagaaagcacgggccccaggctctgagcttagtaataacctggctggtagattcctcatgcccctaattgtcccacttaggcctgaatgtcttgcatggagagaaatctcctgtcagtgtggtccagcagcagggaggagttctgcccaaattccgatatcaccccttcccccatccaagcatccttcgattagggaagtggagagcacatccctgtaaggcccataagagaaagaggagtttgttacatttaatcaacactgtgaagtctgttctacagcaattcagccattacacagtatatgactgaaactcatttaactgggttaatttcatttcttagactgaatatattattgttaagatacgtgtgcgtgttaggtaattctcagcatctcctccaagtaggccgaccttctcggaaaattcaccctaaaagtctcacaaaagaatgagttcatggggagattctgtaaagtgatgaactgagatgaaagcagccaacagcccaggagcttttcagaatagcgtctgcagcagaaccagtttccattcagagcgcgtccttggtggaaatgcttttttgtgtgtctccacgcgctgatggtgg

SEQ ID NO: 258421 - DNA, 1855 bp, Homo sapiens
  misc_feature (2)..(4): n is a, c, g, or t
gnnnggaaatgccctggagtgtgtgtcacctgtccaggacgacttgttgattcccaggagggccgcctttccggtctgggtccccgagaggactgccttgctcacctgtcccctcggcgcggccccggggagctcccgagaggcccccgggatcgctggccctccgaactccacagcaatgagcaagttgggcaagttctttaaagggggcggctcttctaagagccgagccgctcccagtccccaggaggccctggtccgacttcgggagactgaggagatgctgggcaagaaacaagagtacctggaaaatcgaatccagagagaaatcgccctggccaagaagcacggcacgcagaataagcgagctgcattacaggcactaaagagaaagaagaggttcgagaaacagctcactcagattgatggcacactttctaccattgagttccagagagaagccctggagaactcacacaccaacactgaggtgttgaggaacatgggctttgcagcaaaagcgatgaaatctgttcatgaaaacatggatctgaacaaaatagatgatttgatgcaagagatcacagagcaacaggatatcgcccaagaaatctcagaagcattttctcaacgggttggctttggtgatgactttgatgaggatgagttgatggcagaacttgaagaattggaacaggaggaattaaataagaagatgacaaatatccgccttccaaatgtgccttcctcttctctcccagcacagccaaatagaaaaccaggcatgtcgtccactgcacgtcgatcccgagcagcatcttcccagagggcagaagaagaggatgatgatatcaaacaattggcagcttgggctacctaaactaaaacacatttttgatacctaaattaatgagctatagataaaatataaaaaatgtttttaccaagttcagaagttaacaaagactctgctttataattatattgaatgaataattgtgttttaagcctcctaagtaaaagtaaaaaaggagtcatgtgcatacatagaatcagtgatggaggccaggcacggtatctcatgcctataatcccagcactttgggaggctgaggcagttgagaccaggagttcgagtccagcctgaccaacatgaagaaaccctgtctgtactaaaaatacaaaaattagccggacatggtggcaggcacctgtaatcccagctacttgggaggctgagtcaggagaatcgcttgagcccaggagatggaggttgcagtgagccaagatcatgccactgcactccagactgggcaacagagggagactccgtctcaaaaactaaaaaaaaaaaatacatttagtatagcggggggtgggggggagaaataatgttatttcctatgcgaatgacgtgtatccctgtacccatggtaaatgtaaatatactgtgtctcttttgggagagccttttagtagaggagtcttatatgagtctctacataagtagtttcacttgagttttgcagtttgaaatcttaaaggagctttaattgacatttattataccaattaagcttggaatggggcaatggatgcatttcccaaaacgtgtgaaagcactaacagcttatattgctgaatgagaatctcctgggtgtaatttagccacttagggaactgcgtgaacactcccaggccattatgatgctgttacagcttcagtgtataaatgcatgagtattctttctgttctgttttgtgctctcttgtacatttatttaccctttacagaatatttcttgtaaatacataaaaatattggcaattaaaagtacatcttgaataaaaaaat

SEQ ID NO: 258422 - DNA, 379 bp, Homo sapiens
aaaaaaaaaaaattggcggccctcttgccgaattcggcacgagggttttgcagtttgaaatcttaaaggagctttaattgacatttattataccaattaagcttggaatggggcaatggatgcatttcccaaaacgtgtgaaagcactaacagcttatattgctgaatgagaatctcctgggtgtaatttagccacttagggaactgcgtgaacactcccaggccattatgatgctgttacagcttcagtgtataaatgcatgagtattctttctgttctgttttgtgctctcttgtacatttatttaccctttacagaatatttcttgtaaatacataaaaatattggcaattaaaagtacatcttgaataaaaaaat

SEQ ID NO: 258423 - DNA, 397 bp, Homo sapiens
cttaacacacagaggtttgcttcatgcaaccaggtgaggaacatctctaaaacattttacagtcaagaaaattcagtgttcaggaggttgaatgcgttatccaagatcacacatatgtcctgacagatttggggttcaatgaagaattatgtattttaattaagaattatgtattttaattaataattatatattttaatttcacattttaaatttctgcagtttccttccatcacttttcaccatgctttctacacttggaattactttttttggcttcttgatcttctttacttgtatgttattgattttctacaagttttaacatatatgattaaagaatatttcttaatgttttaataattatcctagaataaaatatatttactaaaaaaaa

SEQ ID NO: 258424 - DNA, 393 bp, Homo sapiens
gcctagagtctcatgtactagggaggctgaggtgggaggatcgtttgagctgggaggtcaaggctgcagtgagctgtgatcatgccactgcactccagcctggggaaatattttttcagcaccttttatgtaccaggcactgttctaggtgataggaatagcatagtgtaggagacaggagccctttcatggagtttgtattttagacaagagatagttaataagaaagcaaatttctggtaatgacatgaattataaacaggcaaatgtgatggaggctgatgggggttggagtgggagctaccgaaaaagaagtcgtctcaggatggcaaaatggcgttagttacatagaatcaaaggacagtttctccagcataatcagcaacatgtgca

SEQ ID NO: 258425 - DNA, 456 bp, Homo sapiens
agctacctacctgcaacaaaatcagatcgggggtgccatgagtaatgtttgagtgaaggttgacataagggagaattagggaatattctacggagataaaatggtctctatcctaattaagttggtgggtacatggccatatgtatttctcaaaaatcatcaacctctttccttataaataattgaattgtatgtaattattcctgaataaagttgatttttaaaaagaatgaagtagctcaagctagcggaatatcaaggcagggcagcaagcttgtgttaatgtcaaacatatctaaaatcataataccttgagacaaaggttgggagaggaaaggacaaaagtaataaaaggcatggtttcactcacagtggctggaggtagagaaatttggggttgatatttttagatcagaatgtgagatttcatagcaacctcaaagacaagaagtagtc

SEQ ID NO: 258426 - DNA, 153 bp, Homo sapiens
gtgtgtgtgtatgtagtgggaaaaaaatatatgtcataacattaaccattctaactactttccctttttaagggcacaaaacagtggcattaattacattcacattgttctacaaccatcagcacggttcccaaaccatttgtatcatcccaa

SEQ ID NO: 258427 - DNA, 726 bp, Homo sapiens
cggacgcgtgggttaccatatcagattcacattcagtcctcagcaaaatgaagggctccattttcactctgtttttattctctgtcctatttgccatctcagaagtgcggagcaaggagtctgtgagactctgtgggctagaatacatacggacagtcatctatatctgtgctagctccaggtggagaaggcatctggaggggatccctcaagctcagcaagctgagacaggaaactccttccagctcccacataaacgtgagttttctgaggaaaatccagcgcaaaaccttccgaaggtggatgcctcaggggaagaccgtctttggggtggacagatgcccactgaagagctttggaagtcaaagaagcattcagtgatgtcaagacaagatttacaaactttgtgttgcactgatggctgttccatgactgatttgagtgctctttgctaagacaagagcaaatacccaatgggtggcagagctttatcacatgtttaattacagtgttttactgcctggtagaacactaatattgtgttattaaaatgatggcttttgggtaggcaaaacttcttttctaaaggtatagctgagcggttgaaaccacagtgatctctattttctccctttgccaaggttaatgaactgttcttttcaaattctactaatgctttgaaatttcaaatgctgcgcaaaattgcaataaaaatgctataaacca

SEQ ID NO: 258428 - DNA, 635 bp, Homo sapiens
acactcaatctcctccttcctcccattatgccctaacccttggcaactcatactctgttctctatttctgaaattttaacttttcaaagtgttacatgaatggaatgaataaattacgcaatcttttgtaatcgccttttttactcagcataaatttccaaaattcatccatattgttgtagttcattcccttttatctgagtagtattccatggtagatatgtacctcagtctgtttaactattcactctttgaaagaaatatgggttgttttcagtttggggcttacatgaataagactgctaagaacattcatatacaagtgcttgtataaacataggtttttatttttccaagaaaaacaccaagacagcatttttcagttcagtaattgtatgtttaaagaaattgcccaggagaatggcatgaaccccagaggcggagcttgcagtgagcctagatcgcgccactgcattccagcctgggtgggcgacagagcgagactccgtctgaaaattgccaaactgttatccaaaatgctttgtgaatattttcttccagtctgcagttgtcttctaaacctaacggaatctttcagaaagcaagcttttaatttttatgaaatccaactcatc

SEQ ID NO: 258429 - DNA, 1237 bp, Homo sapiens
ctccggaccttaggtgatgtgcccacttcggcctctcaaagtgctagggattacaggcgtgtgccactgtgcccggccagaagagaaactcaaaaagacaggaacatttccttgaactgatagagcaggagccttcagtttgcaaaggtacaccattgagagagactagcttaaaaaatgtaaaaattgccacactgactgaaattttagaacttctgcgataaagtaaaactcccagaaagttcctgtctgggatagggggcaataggagggaaggcaggtagcatactacctttaaaatttaggaatcagaatagtcctagacttaccattaggaacagtggaaacttagactctaatgaagctgttcattcaaaatacaaagtgaatctgattttcaacctaagattgcatgcttagcccaactttgaatttcggagtaaaaatattttcagatttgcaaggtcatagaaaatttgattctttgtaaaagatattggagtgggggatggattagctaaagcatgactttctacagtgaagagaaaatgtctaaagttgaaaaatgaagaaataggccgtggtcgtggctcatgcctgtgatcccaacactttgggaggctgaggtgggaggattgcttgcccaggaattgaaggctgcagtgagccgtgattgtaccactgccctcgagcctgggcgacagagcaagactgtctcaaagaaaggaaaagaaaaaatagctgtgtaagcaagacatttagaagtcacagagtttgaaattgattgcttctaggggcagggtgtggggagtagggcctagtgttgagcagggcctggagcttacgtattttaaactgtgaactattactttgatagaaatttaaaaaattttagagttttaaatctatatcattacagactatatatattctgtgtttacactgtgaaaaaattagaagtcaatagaaaaagagaaatgaaaaaaatccctttttatatatttgaaaaaattatacctctgaataattgagtcaaagaagacttgttatggaaattagaaaatatttagaactgaataatgaaattaccacatatgaaacattagggataaacatgtttcatatgcagataaaatattagaatatttagttaagaagaaagactgaaaattaattagctaagcattaaactcataaaaacaaaaggtaacttggagaaagtagaagaaagttttaa

SEQ ID NO: 258430 - DNA, 575 bp, Homo sapiens
tgagtgtctgaagttcatcatgccacatttcccagtgtaaagaagttcagaactaaatggaatgatttaaattcttgacttaaggagaccagcagctttgataatgctgccaaattatcctcacagtatcagaaagaaaaaattgacctaaagacttgcgctgtaagaattaaaacagcagaagcagaagctaccctcacctccccatcacttgtctgccctgaagcaggacataagaccctcatttgagaggtgcccttccttatctctgaagacaaaggaacattcttatctctgaagacataggaacatcgagaagaatggagtatgcttatctatgaagacatgagaacacagagaagaatctgaacaaacggggcttgctaagttccctgcagtttatcggcattagattatacaattttgtcctccctttgtatttctctatgactgtccatgattcatcaaacctaaacataataatatacaagtctacttgtttctttgggtcttcatttccaaagcctcccatgttcataaatatattaaataaatgtatatgcttttctcttgta

SEQ ID NO: 258431 - DNA, 329 bp, Homo sapiens
atttccaaaaagaaaattcatcctcaaaagatatacacaatttatcaccacagatgtttgctagaatgttttgtggccacccaacaacatcagttcaagaagttgttgagcaacagtagagtcattcaagtgttgcacctgcccctggtgctaccttgatggaaattcatttacagatacacattctgttatctttgtttaaaaattactttcactacttatgtcatgccctgaatatgattgctctgaatgagagaaaaagagttttatgtagtcgttttgtttaatctatactttgaattttctacattgtgtgcagagaaattggt

SEQ ID NO: 258432 - DNA, 291 bp, Homo sapiens
gttgcacgctcatggtcccagctgcttgggagagtgaggctgtagtcagctgtgattgctccgctacctgccagcctgggtgactgagcgagaccctgtccctttaaaaaaaaagtggggggaaagaaaacagggtggaaggaaaacccagatctgcccactctctggagctcacactccatggggtgaggcaagaggtcaaaggaaggaggagagttggggtgctggggtgcaagggtgctgggcgggggtgcagggtaccagggcaccgggcgcattgtcagtggggtg

SEQ ID NO: 258433 - DNA, 431 bp, Homo sapiens
gaattctaattacatagcatcccaatataaaggatgattaggaaaaactgctttctaaaagataataaatagtgtaacctgcattagattctctagcagagctcataacagttgggctttggtatatcagtttgtgtaaggataaaagtctggatattccagaggtgtcatttaccaactttgtgggcttaaatagatgtttgaaaataataaaaccatttgtgttattagccacgtaaagattaaacatatgttggagtcagattgtccagtcatttaataaaataaatcatttagattatcatgtaatttatttatttatctgtaaaaatggatagaactcttcttattccttttagaatgagaatatcctaggtttctctttaactcatatgtttttgttgttgttgttgtttttgtgaaatggagtc

SEQ ID NO: 258434 - DNA, 493 bp, Homo sapiens
ggactgggaaggagagggcagccaggtgaggaagagaaagctgttctgggtttgggagttgacccaggtggcactttctccttggactgattctgcaggtgcagtgggactacatgtcttctgagactgtaagatgttcttttggggactgggattgctgcctgccttccccgagacgtgtgtgtgtgtgtgtgtgtgtgtgtgtgtgtgtgtgtgtccagcatgtgtgcagctggggccttaacccccttctttcccatcctactgttctcccactgaaagaggcagctaggttctaaagtgatccatcccctgtcggataccgtgtccccatcccctctccgtctccagaggtcggctcccatagctgctgtcctgtgcttgcttcttatttattgagacagggtctcactctgtggcccaggctggaatgcagtggctccatcttggctcacggcaacctggaccctctgggctcaagcgatcctcccac

SEQ ID NO: 258435 - DNA, 870 bp, Homo sapiens
tccgtttcctaaaatgggctgagtgttcttcctcagctctgctgtgcctggaatggcttcccttgtccacacatcccacccgctggaccctgtcctttcttgtaaggggatccaggaggacatgaggaggcagatttactcatctggcagcctctgctgcaacttgtcccatccagtggaaggaaggaagggaggaagggaggaagggagggagggaaggagggagggagcgagcgagcccctcccctgagagaggagtgcagcctggccaggtatccctggtggtggagggaggaagcgaacggtctggggaaatctcagctgctctgtatttttctctgagtcttctaccccagcgggccttccctatcgcccttgaatctctgtttgtggcttcctggcttgcccagcacagagctgagagttcagctgtcaaagccatgtggaagatttccatattttgccagagcccctgtcccacccctgcggccgcccactaggtctttgtgactgaacacctcggtggcagccccagcacctcatggcaaccgaagcccatcattcctactcctcctccaacccgggtcatcttgttcttgcacctgctttgaaagcaagcccacagttctccaaattggccaggctttagaagccaggaaatttttttctgtgcccatcaatgacatccttaagtcttgcctgttttttcactggtaagggaacaactttccttctcctctccaatacatgccccagtgtagacatttgccaccctggactcagcatcctctgtgtgcccattgtcaccagagcagctccttgccaccctgcctagttccatgttcctggccatccccgtttgtcctatat

SEQ ID NO: 258436 - DNA, 409 bp, Homo sapiens
cagagtaagaccctgtctcgaaagcaaaaacaaaacaaaagagtctgcaccgaaggtgctgaaaccacagagtattgggtcatttgttgggcatgttgtacgtgtgagatacctacggttctagctcaagttttatttctgaatccctacatttagtcaattatccccatagctctccagcccaactctctgtttttcctttcagaggaacaaccttgttgtggaagaaaaacaaaacaaaggcaactgagttcagtttttatagaaacttcccagggtcagaacatgttcaatctgaccatatccaaatctgcaatcaggatcaaacagaagtgatgatcaaaaaccacatcctactatattatccagcatgaaacagactagacgtgcataaatatacctactgaag

SEQ ID NO: 258437 - DNA, 702 bp, Homo sapiens
caggcatcttgcctctcaccctgtgctgggccccgtgctccagaacagctcatcggcgctttgcccacatcttctgctggcagagtctccccgattccatcttccacagccctctcaaacatgtgctttcttctccaaccccagatcagtcatcaccctctctctgtcccagatcaaaaacagcctcttaacttgttccctcttgccagccttgcctgtcctgcttatgctccacactgcacccaaaattaccttttcctctgatcatgtcactcccctgcttgccagccttcaacatcacccattgccctccagattcattatcagagcccaatcatcaagtttctcttcaatctctctctctttttttttcttttttttctttttgagacagagtttcgctcctgtcacccaggctggagtgcaatggtgtgatctcagctcactgcaacctccacctcctgggctcaagtgattctcctgcctcagcctcctgaataactgagattacaggagtccgccaccatgcccagctaatttttgtatttttagtagagatggggtttcaccatgttggccaggctggttcgaactcctgacctcaggtgatccacctgcctaagcctcccaagtgctggaatacaggcatgagccattgcacctgggcctttcaatatctttactctgggtttcccttctccc

SEQ ID NO: 258438 - DNA, 485 bp, Homo sapiens
agaatcagcagttctgatatacaaggtcaggagaaaatgatgtcccagctcaagaatggagaatttgcccattctctgccttttcattctgtcagggccctcaacagatgggatgatgacagctcacattgatgagggtggaattcctttactcagttgactgattcaaatgctaatgtctacccttacaaccatacccagaaataatgtattaccagctatctgggcattccttaacccagtcaatttgacacctagaattaaccatcacagagtagatcttaaatgttctcaccatgcatgcacacatgcaagcacgcacacacacacgcccactcacatatcaaagcctcacactgtataccttaaataatacctagtatcatatcggataaggaacccctagtctccctataaataaggagctacagtttctcagcttttctcaaaattatctggaaattctagtcaatgcaggaaaggaa

SEQ ID NO: 258439 - DNA, 262 bp, Homo sapiens
atttttctttttccttttcagcattttttccaatgaaaatgtaatagtgtagtaaaaagaaacaatggaagttaatttaatagcaaaagataatggccagaatattatgttacaagaaaaaaaataaaacaggattttaaacagctatacatagaaaaaagcctggtaggaaacagaccaagatgtcaaaagtgattatttcttttacaatattgtgtcttccaacttttccataaacagcatgtattacttttataatcag

SEQ ID NO: 258440 - DNA, 693 bp, Homo sapiens
gtaatttaagttttgccattactttcttccttttctttttaatttgatgatttttagtaaatttaccaatctgtgtggttatcaacacaatccagttttagaacatttccatcactctggcaagatgctgtatgccaatttacagttaatccttgttcctgttctctgtctcagaaaatcgctattctctgttgtctttagaagtttgcattttctgaacattttaaaaatggaatcatgcaatatgtaggtttttgtgtgtgccttctttagttcagcacaatgttttttttttattattatactttaagttctagggtacatgtgcacaatgggcaggtttggtacataggtatacttgtgcaatgttggtgtgctgcaaccattaactcatcatttacattaggtatttgtcctaatgctatccttccctcagccccctacctcaacacaggctccagtgtgtgatgatccccaccctgcgtccaggtgttttctctgttcaattcccacctgtgagtgagaacatgcagtgtttggttttctgtccaaacactttgtttggacagaaaaaaacactttgttttttgtgatagtttgttcagaatgatggtttccatctgcatccatgtccctgcaaagaacatgaacttatctttttgatggctgcatactattccatggtgtatatgc

SEQ ID NO: 258441 - DNA, 360 bp, Homo sapiens
gtgtcccagaattctgagccacacttgagaattaggttgggcttgcttgagggctacagttacaggaacagagcaggtcaaaaaagcaatatttgagcaagaaactaaaataagaccttagtttttaatcttaaggaccagagaacacatacagcatccaaatcaaattcgggtattcaggtgagaacaagaggctgaacgtgggatacaggagagtgagtctagaagaattttccaagttgaagaatgcagcttcttttaatggtgcacacttagtgttcagtcttaaagagaatgccctgttaagaatgctaactggggctccagtgctgatagattttcaatgaatggaacttagac

SEQ ID NO: 258442 - DNA, 411 bp, Homo sapiens
taagtcagcagactagaaattcaggtaagagttaataatgcagttttgagtccaaattccacaagaaagagcaagcctgctggaaatgcagtccttaggcaaaattacttcttcagagacctgtctttgctctaaaggctttcagctgattggatgatgcccatccacatcttggaagatattattattattattattatttgagatggagtctcactctgtcacccaggctggagtgcagtggtgcagtcttggctcactgcaatccccacctcctaggttcaagtgattctcctgcctcagcctcccaagtagctgggactacaggcacgcaccaccacacccagctaatttttgtatttttagtagagacagggtttcaccatgttggacaatctcttgacctcttga

SEQ ID NO: 258443 - DNA, 553 bp, Homo sapiens
tcccattctaccacccacctccttcactgccttctatacctcaagtctgcccccagctccagcaccagactgcacctaaatcacaccaggtcacaactattctgtaagacacaagaggatttgcgtaacctgtgttgagccaagtgtcacccattcttccataatatttatggaatatttacttccttttttacctttcctaacgcttaatactttgcaaactattggttttgttctgaagcttacttttaagatattcttattttacatacgaaagtgcttccttatgtttgcctggttccaaattagagggtaccagagcccgatctcctctaagcaggaggcttcccataggaaaggaatgttcctttgtgctcatccttcgtataaatcaccagggagcttttaaatgaacaaagacctggctgacccagagggtagaacttataaatagtactccagcctggacaacagattgggactccgtctcaaaaataaaataaagtaaaataaaaattaaaaaataaaatacactgacgatagctgatgaact

SEQ ID NO: 258444 - DNA, 698 bp, Homo sapiens
gtgaacagccagatgaagaagtacatagggcaaagtctgaaagggtcttgagtacaggagcttctgtccctgtgggactggggtgtgctacccactggtatgtggatgtgttcactaacccagaaactctctgaactccatcttttagggattttttttatggaggtttcatcacataggcatggtcaatttttaattcaatctctagcccctctttctccctggaagatctgggaatggggcaatggggctgaaagttccaagcttcgaatcatggctttctggtgaccagtccccatcctcaagccgtttagggactcaccaagagttgcctcattaaaacaaaagatgcttccatcacccaggacattctaaggaattttggagctctgtgctatgatctgggagtggagatcaaatacatatttcttgttatgtcacaatatgcataggtatcttacacaattatactatataaattctactttatatttactttttccctttaacattaaattatatgcatttttccattttgctgcaattgttgtaatgttcactttagtagatgcataatatgcataatttacagtgttaactgtgtcaggtgtttacaataccttatttgatttaattctcacaaaaacctataggacaagtattgttttatttatttcacaaaagtaaaaactgaggct

SEQ ID NO: 258445 - DNA, 763 bp, Homo sapiens
ggaacagggagtgtactgatacaaagttgtttgtcaggaattgtccttgatttacagaaacaacattggttcgtgattggctatccattgttgagctatgcattattaggttaatttgcagctgcttgtggcaatagcaatcagtttcaacagttgaagacatagctcaaaagggagggggagtagaaagtgattgctgtatcgttttaatgtctctctgggcctgataataaagacttgcatccctcagataaaagttattttctcagtaacttagcataaagtattaagttaacatgagttttgtcgtacaatgtgtattatgtttgaatgagtaatatatttgttttgtcaatttaactttgaatcttggccctgaaggaagaggccacagttgtcccattctgccccaccaccttttgggctgatttgtcattggtcaaaggaatgctagtggaaataatgtgtgagccctagcaactctccttttcctcctcccagttcttgagactcttagtagagcttttggagactgaatgagagttgttgagttattggttaactcattgtgcttgacggaaagtaaaaagcaaacaaagaccacacttcttcagttgctcctaacgttttaagagtttcgagttgcctctttgcagttgcagcttccaagggaaattgtttctcaggaaaatatgtgggaggttaaaaaaaaatgcttgaggaaatgtaatttcaaattattagtaaacataacattgaactt

SEQ ID NO: 258446 - DNA, 421 bp, Homo sapiens
tttttttttagttatgtgaagaatggtggtggtattttgatgggaattgcattgaatttgtagattgcttttggcagtatggtcattttcacaatattgatttcactatttcacttatccatgagcatgggatgtgtttccatttgtttgtgttgtctataatttctttcagcagtgttttgtagtttttcttgtagaggtctttcacttccttggttagatatcttgctaagtattttattttatttttttgcagctattgtaaaaggggctgcgttattgatttcattctcagtttggttgctgttagtgtatagcagagctactgatttgtgtacagtaattttgtatccagaaacattgtttcatttaccagttctaggagctttttgtatgactctttagggctttctagatatac

SEQ ID NO: 258447 - DNA, 411 bp, Homo sapiens
ttgcttcctgttctgtttaacgacaccctaacgattacttttcatttcagcagttatagtttgtttcagtagcaacagttatttccagttttagttttgacagcattcctagaactagctccttagggttttttaaagacaccaacgccaaccagcaagcgccccctactgagcggtctaggtcccagctctgagaagccactcaagtttctaagtttatggaacatctaaagaacaaattcatctggctctcatacagtttttaggatactactttgattgacatttcagtttcttttagatctatatcttctatttttcttgaggctattttgataattatttcttaagatattatcaattttcatctagataataaaatatatcattttatgtatttttaaattcatc

SEQ ID NO: 258448 - DNA, 282 bp, Homo sapiens
ctaaacagaaagttctgaaggtcgacagttgcatccttgtctcctgacaagagtgtcctccgcttcacaaatccctaataaacatttggttgagtttctcatatgtattacctgttcttccctgcctttactcgcatgaagtttgctgtcatgaatgtggaatttcactgttttttagaaaaacaatatgagttttgttcctatttactaagtctctgaaatttttaaagtagttttttctcactttttctaatacctaccagtataatttgtaaaaaaaaa

SEQ ID NO: 258449 - DNA, 470 bp, Homo sapiens
tccgatgacaagaacctgagagaacaattggatattcacccattgcctgcagcatcagtgaggaagaatcacttttcatagccaaccaggttacagagtagaagaaatgatgcaagaattagcagacacagaagataatgactgaaactctgccctagcaccatggcagtctgaaaggatctccacactttctcaggaatagtcagccctcggatctagcatgacggttacaaatagagcaacagctcaatgaccgaattaaactaactactggaagaaatatagacccccattcaggcttattccagtgtcagtgtggcaaatggccttgatgagctaggatctgaaaaggaaccaaaagaaggaagaaaaaaaccccacagacaaaataaaagcatattaccttcttaccccctgtttttattgaagttcaaagcaaacaggaaaagacttttaaaaagaagcacaaa

SEQ ID NO: 258450 - DNA, 840 bp, Homo sapiens
tgattacattttcctggtgtctcaattatcttttttaaattttgcattcatactccctgagcttgctcaattttatcttgccattaattcttcatcttctgaggtttggctccataccttctcaggaaaacaccttccaggctctgttaacttgaccataactttatttgtgacatgtttggtattctaacgtgcaaaaaaatattgacatacgggataatataagaaaagcagtttggtttgtttcatagcattagttccattttcagttgttaaacagtttgtaagtgtaacagttaataagtagaggagataattcactactcagtgaccagctatcattacacctttgatactgtaatggtagcaatgagtctatcctaagaaaaatattttcagacaatttcagtagattcaggaacctcctgaaatccatgcaaggctccagtgttaaaacagccttcccaatgtatcccacccacacccgagaattttgagtctccttaagtacatccatctacttgcaggggattgataattatttcagtatctactattgtgtttgtttgtttttttaaatattttttattgtgtttgttttttactttgagtataatttaacagcttggtcattttgacctggaacagttcttaacagcatctcctttagacagctgtttagttgtatgtagttattagacctaattatttgatgttattaaaaagatgattgatcagtagcaattgatagttgagcaattctagtctgaatttgaagtcatttttttgttccttttgatatatatatatatctttcagttgattataattacatatgta

SEQ ID NO: 258451 - DNA, 474 bp, Homo sapiens
cagacggagtttcgctcttgtcacccaggctggatggagtgcaatggcatcatctcggctcactgcatcctccgcctcctggcttcaagtgattctcctgcctcagcctctcaagtagctgggattacaggtgcctgccatcacacccacctaatttttgtatttttagtagagacggggtttcaccatgttggccaggctggtctcgcccagctcatgagttagttggaggctggaggtggggcccagcggcccacggcacagcaagcccgcctacaacactgatgccccgtacatgagactgatgtggctgtcaggctcgccttggccccatgaccaccaccaccgctcttcagaggcactgtctctgcccacatccattcctgactgaggacagtagtgttaggcttctgcagttacccattcaactctggtttctctgctgggaaactaagctttccacagccatggacg

SEQ ID NO: 258452 - DNA, 540 bp, Homo sapiens
cagagtctaggggtttggataggtcagaggaagatcactgaattcaggtttactccacccgagaggagcaggggtcagggtggaaattcagaagtgctcaaatataccatttttatcacaagcaggctgaccactaggaagggagaagatagaaggtgaagatttgttagggaattgcagagagctgaagactcatatgctggagatggctcatacctgctctctagagccgatggatacatttccaaagtttgcaaatcaattgttaaacacagccattattaaaaattacattacaaacttacaataaattacttgagaaacaaaggcaataagtactacaactcatcacaccttaataacgatacattattattatctatgctcttgaggttattcccatcgattgtatctgtctggtgaaaatatgatctgaaagtgaactactgtgcatctctttccaaccctgtatttggtaatatatcacattggtagcttgaaaacagccatggcgggagtatttatatcatgaaaatctgc

SEQ ID NO: 258453 - DNA, 372 bp, Homo sapiens
gcagaccaattcagagcccatttcagtggtgcaggtgagaggtgttagagacctggacaaggtggtggcagatgaagatggagagaagagagataggatctcgctatgttgcccaggctgacctcctgcctcatgcatccctcaccaagcttaacagtttttcaccttctcctctttttcctgcctggaacatgaatgtgatgactggaggtgaggcatctattttgtgaccatgaaacaagaaagcacaaaaggaatagctgagcctaaaaaatagaaggaatctggatctttgacttcaatgagccattgttgagctctgggctcttcattttttgttaagtgagaaaaataaagccttatttatttgca

SEQ ID NO: 258454 - DNA, 261 bp, Homo sapiens
gacgtcccactgacagatctgcccactataaaaataccacaccagcttctcccaaacagtttcacctttcctttctcccttaccttacttataactgatcttacaaggtctccaactccaggatcttgtgcaaagatcttaggagcaaatttgtgtggaaggggctgcaccacttcctttagcactcagatggttattaagctgcccacaaaggtaatgaaccacttatgctcagagaatccagatgccacctgacacaca

SEQ ID NO: 258455 - DNA, 448 bp, Homo sapiens
cctcagcagattagtccttcttcctctgcttccagccatagcaaagggaatctcttctccctcggtttcataccccacttttccatcaaatgtctcctgtctctatttcctccatcagctttgtcttgaatgaggactgtgtggtatctctgggaaggtagagggtagaaaattcctgccttaagttgaagggaaggtgcagaggtaggggatcaaattcagccccaaggaagaacttcacaaacctctggtcaggataggtggctggagggagggaagcagggaggcagagtggtggtagtggaagggcatggggaattttgggagacttgagttcgagttcacattctgccctaacaattacaacggtgtaatctttaagtcacatagtctctctgagtctcagttcttcatttaatatcatcatgtaaaagtaactttgaaatga

SEQ ID NO: 258456 - DNA, 445 bp, Homo sapiens
accagattatctgggtttgaatcccagtgctgccacttactagctgtgtgaccttgaagttacttaaactctgtgtgcctcagtttcctcatatgtaaggtaaagatcataatatcttataggttgctgtggagattaaattagtcaaatacatgtaatgtacttaggtactaggcacatagtaagtgttcaataaatgtgaccgtagttggggtggaattacaggtgggcacttggaaaatatgcataatgcaagtcagttttatctgttgcagtgtgaaatctgggcacctttttgagagtataggatgcatgtaaacattgctgcccagtcacggtgggaatggcagctgggatgggaggaagttgagaacattgttacacaacatgtactgttatttaaacaaataacaatcttagaaaaataaagaagatacggggaaga

SEQ ID NO: 258457 - DNA, 670 bp, Homo sapiens
agaggcaaatttggtgtatgctactatggatgtgatctaaacaacattaaaaaacagcatatttgtcaataatatttttgaatgtagtaattgatcatttaaatgaaaataatatattatggtctcatctttcaataattttgagagatttttctagaaactatacatttaaccaaaatcagtatttttatcatcaaaataatgtttccaagattttagtttgcaaaagttatagtatatgtgaaaagtctcttattttttaattctaaaaactgatcctaaaattttgtatagaaagtaagtattttcactctattaaaaaaatctaactcataaaattatgtatactttaaaaaaacaagttaagtatactgggttatcttgtaattgtttgtcttcttatttatttattcatttatgtatttatagtttgcagtcagctttccagagccagtagatatagtggcttgtatctgtgttgtcacatgtgggagtagtcaaaattgattttgcaatttctgttgatattgattaggaaagaaaccttataaatttctctaaagtcttttaatctacctaattattcatgaaatagtagtgacccttggtattttcaaatatacttaactctctaatcttaggcttttaatttatgtagatggctatacct

SEQ ID NO: 258458 - DNA, 294 bp, Homo sapiens
gagatacctgaggagcagagcatttcgaggggtagaggagagcaagtgaaaggccttggttctgcatccatgatgaaggtacacctaagagggtttgctgatggacgagatgtgggatgtgcgaggaggagccatcatagcgtggggttgcccttgactgacatggggaaggtcatggcaagggtaatggtggtgagaattcagggttgtgttgtttggctttagacatgttataagtttgagatgccagtcagatatctccttgtctagtagcttggtagcattagagttctg

SEQ ID NO: 258459 - DNA, 568 bp, Homo sapiens
tagtatctctctctctctcattctttctctctttcctttctctcaataaagtgacataatggctttcatttgtgcctccactcagaaaatgtgtccctattgcttgtgcaggccagttagttggattacctcatagatgacaaataggaggtgagataggattggggtcagtattcattctcttcattttgtcatggtcctttatgctttggcatttcaaattgatcaccaaaagtagcgaaaggcagctgctgtttgattctttgcttggtgagagtagtaatacccttgtttactctactggtagaattgccttgataagtataacttggatgtacaaagtctagtatttatacagaaattgatcaactgaaaattcaatttctctcttggagaactcactctttaaagatactgcagaggctgggtacagtggctcacacctgtaatcttgatactttggaagaccaaggtgggaggatcacttgaggccaggagttcaaggctgcagtgagctgtgattgtgccactgcattccaggctgagccatagagcgacacttgactca

SEQ ID NO: 258460 - DNA, 259 bp, Homo sapiens
cggcacgagggaaatagagacgagatctcgctatatcacctgggctagtttcgaaccctggcctcaagcaatgctccagcctcagcctcccaaagccctaggattatagatgtgagccactatgaaggggctcaattctgacttacatttctaacagatttggagtggcaagggagcttggatcaaatagtcaaatattcttccatggaggaaaggcaaagaaaggagaaggtgaccccttaggaaatattttagtcta

SEQ ID NO: 258461 - DNA, 668 bp, Homo sapiens
tcaaaataagtgacacttgtttaattctacttaatgaatgtgaatttccaagagagtcagatgcctttcagttagagcttcacctggagccaagttttccttcaatgaaaaacattatttaaacaagaaaaactatatacagacacacatatttttctagttgagtcaaacaactatattcttctcctggaagaaaatctggcactgttagtgccacaataccctgaccaatggcaagttgctattactttccagagtagctttttttccaaataagaggagttcaatttcattctctgtaaaacaatattcaaatgtcgaccacctttgacgtctttcttggataaccatgatgtgccctaatcattattattttttaagaataaacaagaaatgtggagtctcacattttaaacaaaaattcagaattaattctcctaaggaaatttttgtgtcattgacttaaaagggttgagacagaaagctggagaaaaagatttaccccaaagagacataatcaatgatagttttaatcttcctttctcagctaagattcaatgaagatacattggctgtattgcctttacacaaaacctagaccctcgcttaaaatggagcaagctagggagtcccataagaggtcctctttaagacatgacaatttcagt

SEQ ID NO: 258462 - DNA, 612 bp, Homo sapiens
ggaaatacagacacttcagagatactgtgtgttctgttccagactgctgctataaagcaaatatcacaataaggcaagtcacatgaatttgtttctcaatgcatataaaagctacatctatacctcactatagtctattaaatatgcaatagcattatgtctacaaaatcaatgtacatatcttaattgaaaatactttcttgctaaggtcttgcttcaatgttggtgactgctgactgatgagggtggtggtggggtaaggttttggtggctgtggcaatttcttatgacaagaaaacattgaagtttgccaccttgataagctattctcttctctgcagtgctatcaaatgtgatgctattttatagcattgcccacagtggaacttctctcaaatttggagtcaatcatctcaaatttgccaccgctttacaaactaagtttctgtaatatttcaagtcatttgttgtcatttcaacagtattcacagcatctgcatcaggagtagtctccatctcagaaaaccactttctttgctcatccataagaagcagctcctcatccgttcaagttatatcatgagattgcaacaatatagtcacactttaggc

SEQ ID NO: 258463 - DNA, 376 bp, Homo sapiens
cctctactaaaaatataaaaaattagccaggcatagtggtgcacatctgttgtcccagctgcttgggaggctaaggcaggagaattgcttgaaccagggaggcagaggttgcagtgagccaggatcgcgccactgccctccagcctgggggacagagtgagactgtcccaaaaaaaaaaaagcccccacgcagactattggtgtgccctggaactgagcattagctgttccctctccgagttctctcccctacttccccagccttccaggctgggctgtgggtcactgcctccgaggagccctcctggattctgctgaagatggtcaggcccctccatccccccattttctcttatgtacctgacagccctgcctt

SEQ ID NO: 258464 - DNA, 679 bp, Homo sapiens
ccccagtgataacatgtatgaaaatgtacagaaatgcaactattgtgaaaatcaaagacagatattacttccatttatttggagctttgtgaagtgttgtcaccatttgagtaaatcattcactactggtgttatttgagctgttcagaaaagatacccttatcagtcttcacttgcagctgtcactagcccagtacagctgacctctcattgttccttctggggtaaatataaatgagcactgatgtgttgaaataatttaatatgtaatcactttatcttttaaaatagtttacttttattttgcctttatttatacatatatttttaaattttgtatgaattttttctttaattgacacatgatagttgtatatgtttatggggtacaatttaatgtttcaatacatatgtgtgttgtataactatccaatcaagcttgttattgtatcaatcacacatgtgtttgttgtttctttgtggtgaaaacatttaaaagtttatcttctaactatttggtaatatacaatattttatcattaaccatattcaccccctctgtgccatagaattccagaatttattccttccatttaattgtagctttgtacccagtgaaaaatgtatccccatcctctgctttcttctcccctccccagtctctaataacaacggtttt

SEQ ID NO: 258465 - DNA, 1241 bp, Homo sapiens
agtggcttttaatatatttgtaaggttatgcaaccatcaccacttggcagatgctttttagaatattctcagttttaagctggaacatctcagaagtgacctcttcagggccaccagagtagagaggattccaaatcaaagtaatggttgtttaatccagaaaggcccttacactttattaatatgttaaattctatctgttgaggtagataataggtaagattctgtatttgagaatgtgtttttgagactgaagtgcctgcaagaacagtgctcatataaaggtgtttttaggcttcagtgggacagcagatggggtagaggagaggccccacagtatccctggagtatcacagtagtaaacactgcctttcgttacttctcctgccatggctgacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagtgcaccagtacgatcatcaccaaggttg

SEQ ID NO: 258466 - DNA, 898 bp, Homo sapiens
cggacgtatatgccatagctgattctagatgtaacactggtcatctctgctacacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagtgcaccagtacgatcatcaccaaggttg

SEQ ID NO: 258467 - DNA, 676 bp, Homo sapiens
ataaattatatagtatatataatataaaatgtatagtatatataatataaaatatatattatatattatatataatataaaattatatattataaaatatatattatatataatataaaatatatattatatatattataaaatatatattatatataatataaaatatatattataaaatatatattatatatattatataatatataatatatatttgggggtggggagttccacaaaattccaaaaagcaaaacttgaatttgctgttcacctagtactacattgaatctatgtgaaagaagtgatgtgtaggcattgtattaggtattataagtaatctagagatgatttaaagcatacaggaaaatgtgcataggttacatgcaaatactacatatgccattttatataagggacttgagcaactgcagattttgttatctgtgggggtgtcctggaaccaataccccactaacaactgtactaaagatggaaggtattattttaagttctacccacctcccaaaaaaaaggatctttgaaactgaaagtgccatgcaattgtacaaaaaaacaattgctgtgagtttaggaaatgttacaaatctaaatctcgttctaaggaaaattttaacttccaatccctaaatattcccttcttaacagtcaaagg

SEQ ID NO: 258468 - DNA, 725 bp, Homo sapiens
cccagctgagctgttgatgctccaaggtcctgtcagaggcagctgtttgagcattggtccctggagttgccagaggtgcatgaggagggctgggcccggaggtgaaggttgacaactacagccctccgcttctcctgcagagatagaaacaccggaaacacgtggagaggtgtgcacttacggcaggcccgctgccttcttctcctccagcatcctgtgtcctgctgggctggccgtggtgcctggccacactccgaatcaagcctttagttggtgatgtccaaaggcccctcctccagcactctgcacccctggttcagcccgatgtccctagacggtgtcaggggatcctgtacctgaagacatgggagacaaaccattcccaaacaccagggaaagggtgtcccaaaatatcactgtctctctagagaaaggaacccctgcacacaccccacctgagccaccgtgctcacttctcatcgctgtcagagccgtgcacttgggctgccaagacctgtgaggaccagcgggtttctagtggccgcagccgcccgtttccctttccagagctcctctctcccagaggacggcgtccaaccggaaaggtcctttgtgtttggaaagggcccttttctggcacaggctacagcataaagatgaagaagtgagaccacttctaccatactccagaacccaccagccccactttggggggccctgaggcc

SEQ ID NO: 258469 - DNA, 479 bp, Homo sapiens
gaggctcggggacttcccacatcccgggatgggaacttccccagttctccccctcggcgactgaatagtccaggggaactggcttttgtgaaaattgggaatctaagttagtgcattttgaactgttggctgtgtgtgaggtgctgcaggaaattctagtttgataaggggatgccgagggaatttcctggcatggatgctgcttgcttactgcttataagttaatgtgtcaagatagggaccggttgctacaaaagaaatgtaagctggaaaaggaaaatgctaatttgacttccagactggccctggcccaatgccaggcctatgtcttgactgatcaagctcaaagctagtaatgcttcctccatagtctggtgggtgtaaatatatatagacatagctcttcttctccctttcccactgcgatttgcttattatgtctgtattgccatatacttggaataaaggtgtttaccctt

SEQ ID NO: 258470 - DNA, 659 bp, Homo sapiens
  misc_feature (437)..(437): n is a, c, g, or t
  misc_feature (457)..(457): n is a, c, g, or t
  misc_feature (475)..(476): n is a, c, g, or t
  misc_feature (542)..(542): n is a, c, g, or t
  misc_feature (552)..(552): n is a, c, g, or t
  misc_feature (555)..(555): n is a, c, g, or t
  misc_feature (569)..(569): n is a, c, g, or t
  misc_feature (659)..(659): n is a, c, g, or t
ggggtaggaactggggaaaaaccttgtgcacaagacctatggcctaaagtccccctgcctcttttggggtcccacctggagctggagattctccattgtgaactttcctggcacaggaaagttcttgagggaaaattgagggaaatgctgagtgagttctcctctttgctgagcacagaattctcaccctctgttgtacgtggtgttttccctgcccggttgagtcaccgctcctggtcccctccctgctactccccaggttttgcttctttgctcatatgcttatccttttctagatttctcttcatggagcccccattgtagccttgagtgacaacatcaccctagttcacaacaccttagcatgcctgaggactccttttgtaccactgtgaacacacacacacacacacacgcacaccagttccccacatccnctttcaatttcatacagganaactcatgactgtgttgnngaaatcatttgcatggccataggagacacaatgaggcatcatctgtctctgagaatacaggatctncatgtccaangangtgagagactgcangtgcacagaagcccaaggtttcaggatcttggagaggaatcacaggagaccaagtacagcaggacttgccaagaggaccgctctgtggtn

SEQ ID NO: 258471 - DNA, 479 bp, Homo sapiens
ttacaggcatgagccactgcacctgggtcccttaatttcttaatataactattattcatttggagggaagttgttcacaatgctctgagaactattttaattgaaatataatgctaatcatgaaatttctactttacctggccagaaaaagtcctcaggggacaaaggaagtgagggaggtttggcttccacccaagtcacccagtgatatccagggttggttatgttttgtctggttttgcctctcaccattctgtatatgctcttttaagattgggactctattacaaagtccggtctttcagttaaggccatataactgatgggatccccctacttgaagtctttcagatgctgtgagttgagtctcataattgcggcccattcaatactcaggcaatggggatttggcaatagaaaaaacaccgtgcaaactctgaaggtgtctttaaattatcctatgttacagttggattgag

SEQ ID NO: 258472 - DNA, 644 bp, Homo sapiens
tgaaaatatattttcagggaatatttgctaactccttattatgctaggagtttaagatactgactcaaagactttgaagtgattagagcttcctctagagtactgtggcctatgtgtactaaaacatctgattgtccgtccaacttgataatatactgctatcttttgggcctctggtgtattgtgtatttccattatcttcttgctatgaatccttgatgtcaaatgtcagatatggacacagtaatgatgacagttacaatgaaccagtgctgatccatgaagggaatatggaggaaagagtaggagcggtggtaccagactcaatgtgataaagaagtgagtttgctatttgctgctgggtatttttgattctgtgatagttagtgaagttaattgctcctattttttctttttaaccagttgatgttttctttacttacagttcagctatcttgataataatcatgctcatattgggagaatagtcttaagtgcaataagataaaactgggaagagagttcagagatcttcattgtccaaaaaatgcctttctccctcctttgccactgtcatttttggtcacggtaagattaacaatggccccctaaagatatccagcccctaatcctctaaacctgtg

SEQ ID NO: 258473 - DNA, 598 bp, Homo sapiens
ttttgagacggagtctcgctctgtcacccaggctggagtgcagtggcactatctcggctcactgcaagctccgcctcccgggttcacaccattctcctgcctcagccttccgagtagttgggactacaggcacccaccaccacgcccggctaattttttgtatttttagtagagacagggtttcaccgtgttagccaggatggtctcgatctcctgacctcgtgatccactcgcctcagcctctcaaagtgctgggattacaggcgtgagcaccgtgcctggctctgatatatattataatatgggtgaaccttgaaaacaatacacagatgacccctgacttactatttttaaactttacaatgtttcaactttacaatgatgtgaaagcaataaacctttagaaaccatacattagagtacccatacaaccattctgtttttcactgtcagtactgtactcaataaattacataagatattcaacactttattacaaaataggctttgtgttagatgattctgtctaactgtagactaatttaagtgttccgaccatgtttaaggtaggttaggctaagctacgatgttcagtatg

SEQ ID NO: 258474 - DNA, 413 bp, Homo sapiens
tagaagaaacaccaaatacacagcttaaagaatttcattaatacacctttgaaaaacagctctaagaagacaggctattggtatttttaacatgtttactctcaaatgatttatacacttgatcctttcaaaggagtagaaacagcttagaaagaaggcaaaggaaaaagatattgaaattaaaggtagagctccctctaaaaacggaaaatcaaaggaagtggaagccagttacataatactcaaatatatgtataataaggaactgcatgctttgttaacagaaagctgaatatttgggttggacacagtggctcacatgtgtaatcccagaactttgagaggtcagggcagggtggatcacttgaagccaggagtttgagaccagcctggccagcgtgctgaaaccctgt

SEQ ID NO: 258475 - DNA, 622 bp, Homo sapiens
caacttaaactagttgctccctaagcctgtgcttagttttgttatgtcaagattatcctttgccactcccttgtattggatgtcctgtttgctgaaccatgaattattcctcatttcttggcttactcatcattttgatgaattgtgtcctctactagcttcctgagaaggtgtgcatcttttttcagtttttgcatatctaaaaatatatttatgcgaatgatagtttggctgaagtacataaaaataattcccatgcagtttttaaaatgttgtttttactatcttcttatatccagtatttgtattaagtctgatgcatgtcttgctccagtttcttggtatttaggttactttttttctttttggaaactttagtgattatctctgtcactggtgttttgaaatcgcatgatatgttcacccatccttttttcattcattgtattaggcatctgacaaacctttggagtttggagatttctgtttgggagaagttttcttgtttcatttctgtggtaaatgctcacttttattttctgtgttctcctttttttaagaaactcctattgttctgacattgttctgacactgagctcctgcatcaactcctttttttttt

SEQ ID NO: 258476 - DNA, 463 bp, Homo sapiens
ggaaaacaatgagatagaggtagaagaccagttaggaagttacttcagtcatacagatcagttgagagattacggtggcctagatgatggtagtagctctggaagtagaattaaaggatttgaacagtagtgtaaataatgattctaaaattatatgaagatgttttcccacccatagtctgatgtattatagtttatgatacttgaacaatgttctaagatctgcatgagataagaatactgtagaataacataagaatttaaggcagtggctttgagacttctaaatatttttcactctcaatatataccattataggcaggtttaagaaaaagtcataagcattaaaatcagattaactctgaaatgatgagagaatagaggaatattctagaccagcatcattccaagagatctaacataagccacatatgtaattttaattttttagtagctactttt

SEQ ID NO: 258477 - DNA, 1199 bp, Homo sapiens
aacacactaggcaagctcccatcaacaggtctctgcatctgctgttccctctgcctggaagtctctcctcccagctgtctgcgtggttcaccttccttcaattctttcttcaaatgccaccttctcagtgaggccttccctggccattctagataagaccccctactacacctccgaacactccctctctccacattgtgctttttctccacagcatttatcaccaactaatgcactatatactttgcttctttatcattatttttagtctgtctccccccactagaattaaaactccatgaaggcttgcatttttgtcttttttgcttactattttacctgtcaagacaaggatggtgctcagcatattgtaggcgcccaacagatgtttgctgaataaatgaacttctccgaaatgtaataatacctgataatatgtttagcctgatcaatattaattaagtacaacagacagaagtcccagaattgtcatcaaattagtagaacactttgggagggataacaaattgctcattcattcattattccagtcactggaaaaacagaaatgaacaagtacatatgatacctgtcctcatggagcttgcagtcaaagtgaaggtgtccactcccctgccccataaccagaaccaaacagtgcctgtgggtaaggccaaggtcacctggcccccagttctccaagctaacaacatgtgaattatcctcaattctttcttctccctcaccttccaaaacaattacccaatttgtcatcaagacctcttgagtctacctgaggaacgttccaaatgcagtccaactctccaactccactatcattcaattcctcatcctacatcatctgccacttgagaactgcagcattctccaaactaggatctcaccacaggctctcctactccaatctgtcttacaaccttagctggagttacctgccccaaaacaaacactgttccttttcttaaacattttttggccaggcacggtagctcccacctttaatcccagcacttcggaaggccgaggcgggcagatcacaaggtcaagagatcaagaccatcgtggccaacatggtgaaactctgtctttactaaaaatacaaaaattagccaggcatggtggtgcgcccctgtagtcccagctactcgggagactggggcaggagaatccgctgaacc

SEQ ID NO: 258478 - DNA, 251 bp, Homo sapiens
cactcattcattaaatgttccccaaggcttagtctcaggttcgctttttttctgtcagcctaaataacagagagagtctctgtaaaagaaaaagatatgtggtaaattatgtgcatatccagggaggtttaaaaaaagataaaggtatttaaaggaaaaatgagaaggataattgttttgagataattatccttggctacaaagatcaataaaaaaagtgatgccagtccagagtcatacaggcagttgct

SEQ ID NO: 258479 - DNA, 673 bp, Homo sapiens
ccactgtattgtattcccttctattctgctgctgccacctctgattgtaatgactttttcactgggctggatagcagctaaggcatcaaaagcatggtttcctttttccaaaatctctggtctgtctgccccgcccgcaccgcccccccccccccacccccggcctaagataatctttgtgtggcatcttttatttatctaaataagatttttggtcattgtgcttttacttttagacccatgactttggtaattcatttatcacactaaagatcatttcagagccttcttatggctcaatgagtaaaatcctaagaatgtttcttttccaaatagcaaattgctggaagtgagaagcattattttgtccatgagagcaacctaagagagagcagttggagtttatgttaaagacagcaaatggtttattgacttcaaaaagtttagcccctgctgaaacagtctgaaggaaccagcagcactgggcccattaaattcaagaaacaataaatttccgttattggcacaaacattaagtctcttgaaatgtagagccacagtgataatattgctaagtttgggtttgtcatgacaagatattgagaaatctatgaaatttatgacatgttagggaaatgtgatatgccatttaattgatgaacaatccatcctc

SEQ ID NO: 258480 - DNA, 139 bp, Homo sapiens
ggactgttcctcagtctgtctttgttttccacggtgctgacatttttgaagggtacaaatcaaatcttttgcagaaatgtcctttcatttgggcttgtctgatatttcttcataattagatgcaggtcacacatttccg

SEQ ID NO: 258481 - DNA, 248 bp, Homo sapiens
taggattatgggtttgaggagcgcagacaaggttatgggcaaccccagaatcagtaagtttcatttacagagagatcaggattgcaatctatgtggatccagggacttacgtgacatatcaggggcaagggcttccaaaccaagacagactcaaggctgaatcctggccaggccaatgaccgactacatatcattgggttggaaacctccctaagctttgctttcttcgtctctataatggacacagt

SEQ ID NO: 258482 - DNA, 457 bp, Homo sapiens
cgccatgaggtccagggagacagaatccaaggagagagcccagggtcccgggatgctgctcaagagggagcccggggaggggccgggggaggggaccacggaggattccagaagcaacgtccccattgataaagtgccctggtatattttaatgtattgagataatgtatttctggaggagattttagggatgaatcagtgatgagtgatgatagaggaaactaaaatgtgaaaaaatgagacagaacttcaggtagaatagaaaaatgtctgagaaggaaactgtaatatagaacaccacattgctcagctgtgagtgaagtcacggaattgtaacagagtaaacactgaatgttattagtctaaccacaagttatgaaaacaatatgctaaatctcgatcttctgcagtaagaagagatatccagaactgaaaattaacaaaacagcagcgtaga

SEQ ID NO: 258483 - DNA, 404 bp, Homo sapiens
cttttttcatgcccaatgtatttttcatgtccttcctttcttccttcttctctccctccctttcttttttaaaataaatttttataatttttttaaagaaatagagacaggttctcactagagccccccaaagtgctgggattacaggcatgatccagggtgcctggccctccctccctttcttctttccttttgttgattagaattgcaagagggttatccttgaaatctgtgttttcaaagaatcagctcttgaagtttataaggagttctactctattctttgattaagtcatctaatttgctttttagtagtttcttcttccagtttgtttcactgttttgttgagaagctcttttttaagctttttgaatcaagtgcttagtgtttacttcaatacatt

SEQ ID NO: 258484 - DNA, 196 bp, Homo sapiens
taacacatacattgtgtcataaatgttatattaatatacaaaataaatatatatatttatgatatgtgtgcatatgccacgtttgcttaaaaatctatttactcctctttccctttaggtttcggtttcctatttaacattttattgtatcgttaaaatactaaaaactgacctcagtgacagagaaaatgtatac

SEQ ID NO: 258485 - DNA, 326 bp, Homo sapiens
gcatgatcgtagtgtactacaacctcaatttcctgggctcaagtgatccaaccacctttcccctctcaatgggattacagttgagagcaatatttccatataccttgattacaaccctagaaaaatcacaccaggtaacctcagttgagccctgctgagcaggagaaagggagaatccactcaccgaactctgtgctgaaaatgcctccatctacaagaagagatgcgtttttctaattcatgtaaaaattaataaactagctgtatggaatggtgttactctcccacaaacatataaaaaataaagatgcaatcttaaatttata

SEQ ID NO: 258486 - DNA, 371 bp, Homo sapiens
ccttccctacataatttaaaggaaatggaaatcttattcaaccccaatctcaaaaaaacatgtaaattgcaactgatgatattgtcattgaatgatttttactttatctttccattgcattatagttgagagcaatatttccatataccttgattacaaccctagaaaaatcacaccaggtaacctcagttgagccctgctgagcaggagaaagggagaatccactcaccgaactctgtgctgaaaatgcctccatctacaagaagagatgcgtttttctaattcatgtaaaaattaataaactagctgtatggaatggtgttactctcccacaaacatataaaaaataaagatgcaatcttaaatttata

SEQ ID NO: 258487 - DNA, 186 bp, Homo sapiens
agcaatatattgtccctattcagatttcctcatttgcctcaaaaatgtattcaaagttgtttcctccacccctgtccaagatccagtcagggtttacacatttaatttgatggctatgtcccagtggaatttgctttagataagtttatagtgctgttatttatagggctgtagtgatgttgaaga

SEQ ID NO: 258488 - DNA, 376 bp, Homo sapiens
ctatgtaagaaggttgaaagatcatagtctttttggaagactgagtaataataaaactccagtctcgtgttaaaaaaaaaaaaaaagaaagaaagatcatagtctctcttgataagatatggagatcaaagatggataaagcatggtttgttgcctttaaataacttttcagtgtaatgggccataaatttaggctcaattatgtgggtatactatccaaaccttctataggacatttgcagtgctaagtttcagcttgtccacactgattgagaatcactgctgatatctaagaggactgggtggggtagggctggatttttaaactcacgaggtagctgtcactgtcaataaaatgccaatagcaaccacagtg

SEQ ID NO: 258489 - DNA, 431 bp, Homo sapiens
aagattatttgaacacagcactgctataccatgagagtggctctggcagctcatatggttactaagtgaccaacagatgggtagcatatacaatgtggatacttgggacaaagggttgattcctgtcctgggtggaatggactgcgatggtacaacatttcatcatactactcagaaaggcacatgatttaaagtttatgtgtgatttatttctgaaatattccatttaatactttgagaccatggttgacagtgggtaactgaaaccactgagggcaaaaccttgaataaggggagtgggaatgctactgtaaaatgtttcaaggagacaattaaaattagctgatttgcatgcatttcaaaaggccactctcgtggtggtatggagaatagaggaggcaaattaaagtatatcaatccagatgtgttgc

SEQ ID NO: 258490 - DNA, 394 bp, Homo sapiens
tacactggccttcaatctctcctcattgccaggcttctctgattctgggcctcttcacaatgctggttcctccccaaaactctggcatcttttccatagctcttcccacaggaagagcttatttcttcaaggaggccccctgggcagtcctggccaggtgaaattcttgttccttttaaaaaaattttaatagcattcatctcaatgtgcagttacatatgtatttgtgtggctaatttgatgaatatctgtccccttcactagagagtgagtaccatgagagtgggcatcaaggtatgtgctcatggctgtattctctatgcctgcatgtcctaggcactccaaaatattgattcaataaatgaagtaatgatggtttggaaagcatttcaag

SEQ ID NO: 258491 - DNA, 646 bp, Homo sapiens
tctactcgcctgcagttggccattgaggcatcggccgagtccctggcctccctacagcgacagatcacttcggtagcacaggtcgcagcacagaacaggcgggccttagacttgcttacagcagaaaaaggagggacatgtttattcttacaggaagaatgctgctattatctcaacgtgtcaggggtagttgagaccaatttacaaactttaaaaaaaaaagatccaagaggagttaaaacattcctaggaccctctccaccctggtccttcttggtggttttcacctgtggttcaacagatgctccctttccttatcccaattataattctctgtataataatgtgttttgccccaatcctagtacagtttctccgccagcggatacaagaaatcaccagggtcactttcaaccagatgttacttcacccctacgtccaactgccaacctctgatttaggccctctccccagtgacaccccttaacagcaggaagtagccagatgatttcgtcgccccttttctataaccaaaaataggctggactgattggactccagtgaagactccaagatggcgatcaccacctcagataccccgactcagcatttccgggttcacctttcctgttcccgtcaccccgac

SEQ ID NO: 258492 - DNA, 822 bp, Homo sapiens
tatacttaaattgcctaaccagagtccagtgcaaatgtgacctgtttccattatgagtgaatatgagtgatgtgtacgttgttgagattaagggattcccctttgccctactgcaaatatgtaaattatgtatttacatcacatgctttaaaaaaatactagtttatttgatgcctgtttccacaaaggatttaaggtagagaaatattctgtaagttacatcctaaagactttaaactaagcttttattttttgtgtgtgtgaaagtgtttactatcatatttactgtctttactatttgtttgacattagcaccatttaaacttatattggtcaggattgtgaagtttcaaacccagaacttaacaatctataagtttggagggaaacataaaattaatttccatcaatatattacagattattatttgtctataaactagtttttctttctgtatgtactaggtataatacataatagtgttatgtcatacataaatataattataatgattcccctactttctcagggatgtttctctttttattcctttatattctacccaactgagacaacgagttggacagctgagtttaattaccaaaatggcctttggtagatatacatgtccaaagctttaagtgtacttttacgacttttggtaggggactgtactttgaatatactgttatccccaaagttcaaatgaactatgtcatataaaattttgtaaaatatctttctttatatctactcaatgcattattaaaagatacagaattctatcaaatctcatctaagaatactatttttattttaat

SEQ ID NO: 258493 - DNA, 572 bp, Homo sapiens
ttttatttatatttttaatttttccgcctttttcctcccaccgtgtttgggaggatcttttgagcattgtggcttcttttattgtttttgcttttctggaagaagcaaggcgcatcttacatggcagcaggagagaaaagagggaggagggacctaccaaacacttttctcttgttctggaagaacacttcttgtttgttttcacttgttttggaagaagacggctgccatgtcatgaggacactcaagaaaccctgtgaagaggtttctgtgttgagaaactgaggcctccaaccagcagccatgtgagcaagccatcttttaatccaatcctctagcccaaattaagttcccagatgggtgcagtcatagccaacagcttgaatccaacaccaggagagaaacaaagcaatctgaaaggtcatttaaaggtgatacggcatcaagaactgcatctctgagtcaccacttagaggaaacacaccctgcaatgtcacccaagcatctgccttcccagtaatatctgcactggattaatctgtgggcaagaagggaacttttattctgtaaag

SEQ ID NO: 258494 - DNA, 431 bp, Homo sapiens
tcaataaatcaacacttccagcatcaaaaacaaatgcaaagacacataactggtttatatagtataattatataatctattttaaaatataaattctgcgtgcatgccaggccctgaggcctgatggcaagttttaaagttcatttaaggaaatcgacttttatctgttctgtcaagctgtccctgtgaatgttcattaagcaccatttgggaaaaaggctacatttgaggccttttgtgactagaaggcctgagccagatcctcccatgccccagaccctggggctgatcctccctccaacactttgactggagctctgtctctctacctccccaagacacacacacacacacatacacacacacacgcacacacaaacacgatccatctgtgggattacggttttacccggctccattcctgtcttaga

SEQ ID NO: 258495 - DNA, 559 bp, Homo sapiens
ccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacgccgagccctatgcacaaaaacaaggtattgtctatgcttaaggaaccacctctgcatgaaaaatgtgaggatgggaaaaccgagaccacttttgaaatgtccatgcataacacaatgaagtctaagtctcctcttcccttaactttacaacatttagtggctttttgggaagacatctctttggctactatcaaagctgcttcccagaatatgatttttccaagtcctggttcctgtgcagttctt

SEQ ID NO: 258496 - DNA, 534 bp, Homo sapiens
gagcagcagcgacatgagggtggacttcattttcaggtatggagttttcactgagtctgattcaacacagtactggcagaaaccaaccagaagcatcatcaaacaaaagcttcctggaagttctccattgaaagaatggctgtgtccatttgacgtggaacctgcaatgctgcccatctcactcacagtgaaaagcagaggcctcacaacatcctgtgccacctggccctcctttattcctctagcctcatagctcacactttcctctttgcccactgtcctctttgctgttaaatatgtcacacacgctcccacctcagggcctttgcaattgctgttctcccatcagaaaatgctctttctcatctccttcaggtccttgttcaaatatcagcttatcagtgaggttttccctcggcatctaggtaaaaatgcaacactttcctttccctggccctccaccctcaatcttttttgtccttattacctgttttaattttctccatagcccttataatcttaaggcagtctgta

SEQ ID NO: 258497 - DNA, 439 bp, Homo sapiens
ccctccccagtttactgacactaggagtctcagccatgaacctaatggtgggcttgaaaagtggagtacggcttctgcatttctatacaacattaagtttcaaaggacagatgaaagcagaagagccatagaagaaggctctaggtgctcagttactgctacatctttaccatcctgcacgcctcttttacttatggctagattcccgctaacaaatgttggataagaaacactgtctgaatcacaagaacagagaggttaggagaaatagttttgctcactccttccatgtggtgaaacatctactaatgcaatactccagtcctctctctatccttactcacatgaaaatgcaatggttcgatttgtaaaggtaaataaacagatgtgttattttgcatgtatctacattatacttgatatttgaaatctgccgtca

SEQ ID NO: 258498 - DNA, 468 bp, Homo sapiens
gataaatcactgcaaagaatgaaattggcttattcacatcaaaactagataagatgctaaaaaaaaagatatgaaatagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttg

SEQ ID NO: 258499 - DNA, 611 bp, Homo sapiens
  misc_feature (363)..(363): n is a, c, g, or t
  misc_feature (365)..(365): n is a, c, g, or t
  misc_feature (376)..(376): n is a, c, g, or t
  misc_feature (383)..(383): n is a, c, g, or t
  misc_feature (427)..(427): n is a, c, g, or t
  misc_feature (448)..(448): n is a, c, g, or t
  misc_feature (488)..(488): n is a, c, g, or t
  misc_feature (509)..(509): n is a, c, g, or t
  misc_feature (524)..(524): n is a, c, g, or t
  misc_feature (586)..(586): n is a, c, g, or t
  misc_feature (594)..(594): n is a, c, g, or t
  misc_feature (596)..(596): n is a, c, g, or t
  misc_feature (608)..(610): n is a, c, g, or t
gatttcacagtcttctaagcttggaacgcttggaaaggctggcttggcagtaggtagtgtggccggcttgccctattccttttctcttgtgttgtgactgtggcgtaacttagctgccatgggtttaaatgggtttccaagatggcgtttaacttcctgcctggtgggagagaaggtggcttgatctcagtaacatcaacccacttgctctaagatttagtagaattcatggtcccaagtatatttatgccaaggctgctgattctcagctcctcggcatatggggacaatggggaaggaagatcttggcccattgccatctcctgacagttcttttggctgttgttttatcgctgctttcananagtgacttttnctgtctngttacagtgattttctcctccctgcagtgtgcagggttatagcnttgctggtttgaaaagagacnactgattatttgaaggcttaggtggaaggatgttaggaanattcagatctgttctcactanatgccagtaggaaanaaggcatcatcttttgtgttcaccgcattgactctcattctctcatgttcatttctcatgantgttgganantctggtgtttgnnnc

SEQ ID NO: 258500 - DNA, 369 bp, Homo sapiens
aaaaaagttcataaagactgtagtcttgtagggaaatgctcttgatagacaattaaattgcattcagacttcagcaagggttattgattgcctaccgtggagaaatatactggttaagtggtgactgtagagtcagacccagattcagagctctcatagctttcccatcattcacatatcatctgcttccatgagtgtgcgtgtctgttaccacctaagactggcttaatcaataagaaaacactcagacatacttggaagcctagaggaaggctgctttaagactggttgattcagtgactcgatgatgtaattaaagaccagggttcctggactccagcctgggcgacagagcgagacaccgtctca

SEQ ID NO: 258501 - DNA, 2075 bp, Homo sapiens
tcactagaggtggtcaggcaatgaagagtgaacagggagttgtagtcccttggatattgatgtttccaggactaaatcacattggagaacaatcaattcacaagctgtaaagccccagctttaatcactttctctctcagaaagatggtgcctgctctccatgtaacttccatctcctcagtgccagagacagggaccacactagaaggcagtgattgtccactgagattttgtcccctttaaattaacctagacatttgtcatcacagacaggagcccccagagtaagcttacagcaagtgaagtgggaatccttgagggcaatgtcagcctgccctacaacgttaaccctttcaccaccgcatactatgcacttatttaacaccctactctgcctggtcttcagcttcacaagccatattgacagaaaccagggatttacattcttacttgaaagctgtttttttccaggtttggagcttagagatgaagatgggagttccaggaggactgaggcccatcttggagatgaaatacttcctggcgaaggcaagcatagcctttattttgcacacttcaagtcagaagcctcaaatcaccttctgcccttgaccctccaagcccactttcacactccctccccgcttcgctccccgaccccaccccatcaccactctgctactcgcaacgctgcctggtcgcacccaggaaccatctttgtgggtggggttcctcgtctccgcggacaggctgctagtgagccgcagctcctccatccggaagccagggatcttcatcttgccgcggagttccatgctgccgtcgcccccagtcttcagggactttgcgctcccgcaggctcctgctcacctctcccatcgttgggcgctggtggcaccccaggaggagagaggagcagcaggagcccggtctcgcagtgccggcacggacagtactctgggggtctgggccgcgtgccacgaggagcagaggagccaccggagccgcttccgcagacgccctgacacggaggacccagagcgccgcgccgcgccgccgaggaacgcgctcaccggcgccaaattttcccatcccgggagcgagggcggcggcgaagggtccgggacccgaggtggcggcgcggggctctgcgcgggcggctgtgggtgctggagctcaggaccctaactttagcgaagtcgggccgcggcggggcgggtggaggcggcgtgggcaggggctgccgcaggtgcggagtgaggcgccgccacacgggcgggggcaggagtctcaggaactcggcagccgccagcagagcccggtgcgggaccgggagctgccggggcctcagtccgctctccccacagctctccgtggctgcaggttgaggtcgaactgcaagcgccacggaccctgcctgctgtttactgcgttttcactggagactccagcaaatgtcctggagaggagagggattcctgctctgtccatttagtctctacattggcaccttggtgtaaacccacagcagaggctgcgtgtcctggctgagaaacacagaagggcagcggggacggaggtggggccgtgtgcagatgaagtatgtttatgaagtacatgattgtgagcgtcagcgtatgtgtgtttagggtttttcccatcagtctccagctttgctcccttttcttgaccttctgtagcactcactctgcccaaagccagtcttgcgtaatcccatttgaaagagcactttgttactagccatattctaaatgttttgtgagcctacactatggctttagaaaaaaaaaccacacacaccacactaggggaaaagaaaggaactcaaaactgtggcttgggaacattttcatttggagcacaccaattagtcccagggtttagctctaaacccaagattccgtaggaaatcggacatctattggagacttatctactacgtttgttatatgactgttaaaccaattcattgacctgtatcacattccccacctcaacccttgaagcagctggcatgccgtctgaaatcttggaataaactttgcatatggtta

SEQ ID NO: 258502 - DNA, 509 bp, Homo sapiens
gcataatgtaaaaacattagcatatatatccttcaaagcattctgactttacttttcagttctcagtagcttctctcatgctttaaaaacggagcggaaaccagccttttcctggtgcgcattttgtgggcttcagtcagctgcaggtccagcggcttctgcgctgtcgggggcctgcaccgcctccctgctcttgtttagtctcctttttcatttgcagggcagcgattcccaactgcgggaaggagcttagatgtttttggcagttcccgtggagaaaccctgtataagttatcgccaggagctgaagggattgagttatttcccagcggcctcgtgactggcggtggggtcaaaagaggagtgtggtggagagtggagactggcacccagcgctccagccccagggagggcagtggattcccagggaccccgggactcagtgggggatcttactttacttctggggtatgaaggttggcatcttgttcagatggactcacagatta

SEQ ID NO: 258503 - DNA, 460 bp, Homo sapiens
cccaggctggagtgcagtggcgtgatctcggctcaccgcaacctctgcctcccaggttccagcgattctcctgcctcagcctcccaaagttctgggattacaggcgtgagccaccgcgcccagtcaatgcctgcatttttaaggtgaaatattatacagttaagtgttaaacaagtgaagaatctcaacaaaatacatattacctttaaggctctaaatgaccagagagaaagaactgtgaccattaccattaaaacgttcacgtcctggcctatacatttcttttaccgttgccttcaatttccatatattttggttcttcaagttagctggacgttctatgaggtcagggagcaagtgtatatccctaaactgctgagcctcaacactcacaggatgcctaccaacagcatccaactcttttaagagacttaaacacccaggttactgtccaaatgag

SEQ ID NO: 258504 - DNA, 559 bp, Homo sapiens
ggaatggaatggtgaggtcatttgacctgttccaggtgagtggaggccaaagaacattctttctgcctccccttggatgggaaaattgagaaattaaaaagttgcctttccgaggaaacaaaagttattttctctatttaaaataaatgtccaaaggcacccctctaaacaccaaaacttttagctcctggcaaacttacctagctagaagttggagaagagtgcggtttcaaaccatgcttcctttctgcccttgccaatacgttctcactgactgtgattctgctgtgaacacacacacacacacacaaacacacacacaagccccttctgtgtatgatcaggacaagtagttcaacagttaataaaaaagttaaattattggatgagaaagatatatttaacctaaatcataaatatgtatatccatttaataaacactaaaattgagaaaaattagtttggggatgagggccttcattcataatagccataatgcattatctatgatgtgagcttgattgagcttctttaaaatgcataaagaatttgaacaaca

SEQ ID NO: 258505 - DNA, 432 bp, Homo sapiens
ggtttatattcaaatttggtcatctgtattgttgaagtttttcattatgagaatatttttataatgtcattttatctccttgagaatgttttttgaggccaggttctgaatatggttggaagtaagttgggataaaaatagaacagagttaatttttagctttaatttagtggtgaccttggaagtcagctttattaaggtactgttagatttcttctgagaatttttggtgaacaaaatctactctgctcactagtaaccccaagaagatccataaaagatcagtggtttgttttacaggagctgcctcataaatataggagaataccaactgatagtgtctcttcccctcagctaataagggtagacacttaataggtataacctagacttatttttttttagccaaatgaacttaaatagaaaaatgta

SEQ ID NO: 258506 - DNA, 765 bp, Homo sapiens
tgtggggagagtgcaggctgaagagttacctaaggtcaaaatcctgacctatgagccaagccatcgatttgggatttctactgaggacactggaagtcactaagagcatctgaatgaaagaaaataaaagagactgagaaaccacagaaataaagaagcgctgatgacaatgcctgcttgctgatggttacgatgatcatagcagtgtgcattttgtatgcatgaagcctgcgactaaataaacgtgtggggaaatatttgtaaggaaataagctattaataaaataagctaaaatcacaaaaaaaaaaaaaaaaaaaaaaaaaaaaaaaaaaaaaaaaaaaaaaaaaaaaaaaaaaaaaaaaaaaaaaaataaaaaaaaaaaaaaaaaaacaaaaaaaaaaaaaaaaaaaaaaaaaaaaaaaaaaaaaaaaaaaccccggggtttttttttttttttttccatactgggggttttttttttaaaaaaaaaacacagttccccttttttaaaaaatttggggaaaaaacaattttttgggaaacccgggggggaattaaaaaattttttccctttgggattttttccccggggaaaaatttttatttttaaaagggccccaattttttatttatccccaacttttttttcccccctttttaaagccctcaaatttttttggggtttaaaaaatatcccaaattttgtcgccttaaaatttaaaatttaaaaagggtggttcttcccctttgattctttttctggg

SEQ ID NO: 258507 - DNA, 277 bp, Homo sapiens
aaagaaatgcaagtgagaatagtggttttctctgagtagtgattaagtgtggaatgaggatggcactcgaatggttgataatgttctattattgttctgttgttgtgcttgcatggtgttcattttctgaaaaatcactgagcagtacattttaaaatatttcttatctatatttgttgtatttcacaatttaaaaaagatttttaaaacaaagttagtggttcttattgaacaaatacaagtggttttccaaagtaaatacttctctaaacttaaa

SEQ ID NO: 258508 - DNA, 384 bp, Homo sapiens
gtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactacc

SEQ ID NO: 258509 - DNA, 507 bp, Homo sapiens
ctgagagtcatttgaccaaagtttggctttattttgcatacaggaaaaattagcccctagccttttctcaagaagtgatgctgtttctaaagaagaatagatggggagatctgagacatccagagagaggacaatgtgtccaaaaccagctgaaggcagagagtccatgcctcattcattttaggagtccctcatgtctaacaccatcttctgtgtcctaaagccagtatatatataatatttttaaaactctgcaaagattggaacaagaagtggtgggatacattttttggcataaactgggctatgtgtgcccggtattttttctttcccccctatttctttggagggttttgttcagaaacaatgtgctatagccagagagagtcgatcttacaaagtccctgcatttactttcacagcaagaactgctaccttgattagacaggaaggagaacaactactacaacaaagagaataaaatacattcagtttggtaaataacca

SEQ ID NO: 258510 - DNA, 438 bp, Homo sapiens
aaattattctctacttcttaaaggcacttttttttggttgctatttctgggtaaggtttactttgataagtatcttagaatcagtctagtgttgagagttgatggtggaattgctgttcatcaaaaatgagcttgagttagatctcttagactagcagtcttggatccttttaactgtggaagaatgtctgcaatggtgatggtaccattagccatttggttaaaggggttgatactgattataaaaaatgtgagatattaattggggtttttacaagtggatttttgatggttgattttagaattgttgagtttatcaaagagtttcaaaatgtccatgggtatgggtagagacgaatttttttccttcagattcagtaatctctttactcttgaattaattgtctctgacagatgcatggctgatttggactggat

SEQ ID NO: 258511 - DNA, 309 bp, Homo sapiens
ccctctccatttcttctatttaggcctcatcatttctgatctcatcgctcaccataaaaacctgctaagaatccaaccttcgcattagcacccaagtgattattgtgaaatttaaatgtaatcaaatcagctctaaaacaagggttactgtgaggataacaatatggcaacgtttgtagagtgtttagcgcagtgcctggcaggtcctcacaaaagaaagaacagatgaggaaagagaaaagaaacaaaaagtcagctgtcacaggttatatcaccccatccctaaaatcctccagtgtctctcaagag

SEQ ID NO: 258512 - DNA, 423 bp, Homo sapiens
tgtatctcttggagtaacatcaaattaaactctgtcttccctagtaccattaaacagttcctagccactagactgagagtaacgtgttattgggcaaatggatttgagattattattgagaatccttttggttgtaagtggttaaagttgcagattagttgctggctcatgactgtaatctgagcactttggaaggctgagacaggtaggcttgcttgagctcaggagttcagcctggccaacacagcaagatcttgtctctaccaaaataaaaataaaaaaatcagccaggcatggtagtacacatctgtagttataatatttgggaggctgaggtggtagcatcacttgagtgcaggagatagaagcttcagtgagccatgattgtgccactgcactctagcctgggcgacagcctgtttc

SEQ ID NO: 258513 - DNA, 620 bp, Homo sapiens
ctcagcctcttataatgctcccatttctctctctggtctggccaacccagctcagatctgaactgctttttctcacttatgaccagggcttatctcatcggccttggagaaaaactccacttggagttcccacttggagaaaaactcttgattctaatgccttatcctgtattggtggagagaatttaaatcaatgttcagagtcccagaatttccacattgaagtcttcctggccagcacagagtgataagtgactcacattctcaaaaatatctataccaaaactacaagatcatgcctcttactactcctactcctcaaggtgaggaaatcctagacaaactacagtgtaacaaagtccctgagaaaagtgtcactccctcttttcttcaccaatcaagggaagacaaaaacaagcagaattttaaggagttttctgaatactaattagtagtatgagcttggacaactcacaacttgttggtcttcaatttccccagctgtagaaataaaacgattatacagaatgatctcaaaggtctcattcaattctatgcagacatatatgttcccaggccttagtgggtttgcaatctggttgaagtagaagactagccat

SEQ ID NO: 258514 - DNA, 336 bp, Homo sapiens
ttctctttgatttctgctccaggaagatacttacctcggttctgagcctgactaatcttatggattttttcttttaatattttctcatgtgtttggagctatagggatgtgattaaagataaggttctggagccatatattgatgacagaatgttataagcaaaaatataaaaaatgatttcaaattcttcttgtatttatacctttaaggaatatcttcttttgattaaatatataagcattatatgtattggatgtatcagtagagatattgtttatagattttcatgtcatttttctataggtaatagtcataattgatgttatgagcttttt

SEQ ID NO: 258515 - DNA, 686 bp, Homo sapiens
cttcaaccttgatggcaacagccgatcgtggtggtgactgagggtgggcaatatcagtgggcctccagagatgtggaggtgcagggactgttgggctcccagtcaggatgcagcctggtgggggctgggttctcaggaaggcatcatgctatataattgcttacggctcagggggtgtgtgggacccaatgtgatcttgatccttgaagcaatgcctttgcccagtttccaggcagtttcctatgttattcttgggctcttgagggtttagggactttgctgtggctgggaggcaggagtctacagtaggaatgcagaccactggggtcactcacttatcctttcctacactcggaagcctctctagggtctccacaaattcttgccaaccaggctttctcactttcctgttctttccttgctttgggcattttctgtcacttttctgttgaatgaataataatagatttctttaaaacagaacaatttatctgagctttctaaactgatgagaggaccactaaatatgttatatggaggtgtataccctagatatactaggaaaattttctagtaattatatatatgatagaaatactgaaataaagaggtggtgaagagagaaattggcatgtatgtctattcatcctatatgagcagcaccggtattgaactatgattttctt

SEQ ID NO: 258516 - DNA, 665 bp, Homo sapiens
gtcaattattaatgatatgtagaaaattagagaattgtgcctgttgataagcatccaattctggttgaactcaatttttatctgtatcagagagagctgagctgatatagctaaaaattgagatatatgtgtgtgtgtgtgtgtgtgtgtgtgtatatataaatatatatatatcagctatatatatagttgttatagctaaaaatataattatttatactgtgaatttattatacttttctattttactggttatatatattatatatcgcctatgtatatatatcagctatgtgtatatatatatcagttatgtatatatatatcagctgtgtgtgtgtatatatatggtcagtttattctctttgaaggcagacacacttaacttcttgcatgaatatagctttaactattttatcactatttatcatgttagtatgctacaagtttctggtagaaaagctctatcaagctaagagagcattatatggaaagattattgaattttattaaatgacttttttcagcataaactaaaatgatgacgtttgtctttttaaattggttaatatttaaaaaattattttattattggcttagaataaacttacaatattttattttgaatttatgttatgtttataggtgagattggccttctttct

SEQ ID NO: 258517 - DNA, 345 bp, Homo sapiens
gacagcagcgggagaagaaaagggcctccctgggatgaccttccaggagacaactgctacaagaaagcctatgtacagttaaaagagcacaactgtccctgatcacatggaagccttctccaggtgctgccacaaacaatgggaaggggtcttggagcagaggttgggatctctgacaagtgcagtgacaagctaaatgagatcatgctgtctttctcaaaagtggaacagtggctaaaacaacatgtaaagcattgatcctagtgcctggtaagaggaagccttcctatactttacttccccagcctcttcagtggcagtagtaaaagatttcaaatccttcct

SEQ ID NO: 258518 - DNA, 641 bp, Homo sapiens
tgcctgttgactctggagccctttgaaccagtgtacagtcgtcagatagggaccggtgaacacctgattccaaacatgtaggatgggggtcttgtcctctttttatgtggtttaatagccaagtgtctaaatgcaatcagattgcatttagaccagcaactgaaatgaatgagataactcttcacctgtagttaccatgtcccattacaactcctgttttaatggaagtaagtgtgtaatggaagcctgttgatcagaaaaaaagagtctggaacttaattttcatttgcttcagagttgttcatttgcctagaaagcttttaggaaagagctttcttaatagttggaaaagaactgttcatttctgtgtaatggttatacttttaaatgtttataatgtgatttttattcataggtagtaacatctacaaaagttttaggcaatgagatttgatattatttcatgtcagcccactgtggacaaaatgttttcacagatactacttaagtgaacctagaaacagagatgtagatcttatactctgataagaatgctttaaaatactattaaatgtaagcatatttaatgttatatgtttatcaactcaagaaatgtttaaaaaataaaaattttaaatgta

SEQ ID NO: 258519 - DNA, 894 bp, Homo sapiens
tttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactata

SEQ ID NO: 258520 - DNA, 307 bp, Homo sapiens
ccaagcacacttgtgaccttgactcccaaagcttagctcatgctgtttctttcagcctgcagtattcctccttggtgggtcaccaataggcaccctgtgcagaaggctgaggcagaaggatggttgaaagcaaggccaagatttccatgtgcagaaagtcttgcaaatgggactgctccctcagtgccctctctctcccttaaatcatttgtaacattatgtatgcatgttggaaacaatggtatctccccagcttccccgttaagctctgagagttgtgaaagtgttctgttgaccagtgtcttga

SEQ ID NO: 258521 - DNA, 350 bp, Homo sapiens
gatggattggaggctctaaaacaagctgagataatgagctaaaaggttttacagctcctcctgccaatctctcttctcttcaagacccaggaattgggcctgcagtattcctccttggtgggtcaccaataggcaccctgtgcagaaggctgaggcagaaggatggttgaaagcaaggccaagatttccatgtgcagaaagtcttgcaaatgggactgctccctcagtgccctctctctcccttaaatcatttgtaacattatgtatgcatgttggaaacaatggtatctccccagcttccccgttaagctctgagagttgtgaaagtgttctgttgaccagtgtcttga

SEQ ID NO: 258522 - DNA, 408 bp, Homo sapiens
acacatcatgagacctcattcagcccttccaagaatcctctgaagggttctgattttacagacaaagcaactttggcatggataagtgattggctcaaggtgttgccgctagtcagtgccagagccaggactccacacaggccatccgactccccagcccacatctttcacttgtacagcagattgccaaactcatgttgatgtggccaggccttgtgggggctctggtgctctcaagtacagatgaaacactgcacccccgcccccatgtcactgggttgctgccaagtggccctgccatatcctcccatttttaaagaagtcaggaatcctaatttgtatgtgaaacccaacttttgaatgtcagtaactatctttaattaaataactactgatccaacaaaaaat

SEQ ID NO: 258523 - DNA, 772 bp, Homo sapiens
ctagatccaacagcagcttttttaaaaaagaaaaacatacctttctcattttatttaaactgactcgactgtgtcattttctgttttaatttcagagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttg

SEQ ID NO: 258524 - DNA, 972 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 258525 - DNA, 662 bp, Homo sapiens
  misc_feature (21)..(21): n is a, c, g, or t
tatcttttggtggagtgaaanaatttgagccagtgaagccaaatcgtaacttacagcaagcagcatgcagcatacctggctctttgctgattgcaaataggcatttaaaatgtgaatttggaatcagatgattgcatttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcttcattttcgtatattcccgctcttttctcttcatttccctgtcttctgcataatcatgccttcttgctaagtaattcaagcataagatcttggaataataaaatcactatcttaggagaaagaataaaattgttattttcccagtctcttgccgtgccatatgcagggatcctctaga

SEQ ID NO: 258526 - DNA, 3189 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattaaggtgatcactggctcagtcggactggggtccagaaagtctgagcccggaacaaagggatcaatcaccttttaagcaatttgtggcgggagtttggtgctacaggaagcctacttgcagaagcaagaacaaaggcagttaattattcttttacatttgttacaccacatgtcttacatccttgggaatgcatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 258527 - DNA, 3262 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattaaggtgatcactggctcagtcggactggggtccagaaagtctgagcccggaacaaagggatcaatcaccttttaagcaatttgtggcgggagtttggtgctacaggaagcctacttgcagaagcaagaacaaaggcagttaattattcttttacatttgttacaccacatgtcttacatccttgggaatgcatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttg

SEQ ID NO: 258528 - DNA, 1883 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgtaggtgacctgtgtggcgcgggccgggcggggcctttttgtccttgggcaaacgtggtatactttctcagtggtggttggaaggaaatttgttgccctgtcatttcgcaagtatggaaaaagacctaaaggagaatttagcagctgcagccgctgtttttattgcgtactttactagcgccaactctttaataatcgcttgttagttgttacccctgttttatgggtcaagagactcaatatatcagtactttggtaaggccaggcagcaggtaagttgtaaaaccagtaaaaaaacacaggtcattagtcaaaagagtgcttcaggtctcctgactccaaatccgagaatcctttcactgtagcatgtttactgctcaaatatttctacaaccctattgcttaacaacaggaatgaattatttcaccatttgttgcaaacgtatgggtcacgttttgtgccagcagcagaaaatacagaaattagtaagaattacctgccctccaggggcatcaccaacctggattcccctctcggcccagtttttccacccttattgccttctcccttcaggaataatgaactcgtcctggaagcgtaccttactttttaatatctctgccttgtcatgtgctgttcgtcttaccaggaaactaccctgcttttcccccagttttggtctgtgaacacatttgggaaattcttctgatcctaccgctactctcttgagagagagaaacaagggaaaaaaaagttaattgcctgaggatatactgctagtgttgcgggacaaatagagacgggagaggccaaacagaattcaggacaaccctttattattaagcgcgctagggagggaagcaggaactcgtggtgcctcaaggaacgtgaaacggtggaacacagataagcctctccatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttg

SEQ ID NO: 258529 - DNA, 2539 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgaggtacagtaaattgtctttgacttccatcaccttttgtaatattacaattgccatctactgagttcctatgatctgcctggcattgtactaagtgctttatattttcttgttcatttttttatgccaacataaatgagtttgactcaattcttattataacctgccaaaataagtattcctcttcctttttacagagagagaaacaagggaaaaaaaagttaattgcctgaggatatactgctagtgttgcgggacaaatagagacgggagaggccaaacagaattcaggacaaccctttattattaaggtgatcactggctcagtcggactggggtccagaaagtctgagcccggaacaaagggatcaatcaccttttaagcaatttgtggcgggagtttggtgctacaggaagcctacttgcagaagcaagaacaaaggcagttaattattcttttacatttgttacaccacatgtcttacatccttgggaatgcatgcttttgtagcaattgcttatcaaccttgtgactttacagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 258530 - DNA, 2091 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcttttggtctgtgaacacatttgggaaattcttctgatcctaccgctactctcttgagagagagaaacaagggaaaaaaaagttaattgcctgaggatatactgctagtgttgcgggacaaatagagacgggagaggccaaacagaattcaggacaaccctttattattaagcgcgctagggagggaagcaggaactcgtggtgcctcaaggaacgtgaaacggtggaacacagataagcctctccgtgcgtagaggagaaataagcggttaatattctctcttaacccaggcctccggagggtggggggctatatttcattctacctctaaggaaaagaataaacttcttgactaatatacttataaaattcattaattcccccttcactagtaaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 258531 - DNA, 1577 bp, Homo sapiens
ccattccattttatcttagacataatatttattagttttccaagcacgacataaataataaatacctgacttaggattccaaaataggtcttgaatttttctgcaggagctcctcaaagtctctgaattcccacaaccttttattagatcacttatcccattgtattataattatctgtttaacaatttttcctcacccctaaaggaccctgagcttctggaaggtagggactgtatcttaaaatcttggcatttctgatgtctagaatatttcatttaagagaagggcttagtaactgttgtgtgggtgggttgatgagttaactgtcaggcaggtgaactaataggctgaagataaagtttttcactgttggaagtgaatttgggattagtcatcctaatcccctcacttttagagatggggcaactgagtcatgcgcggtggctcacgcctgtaattctagcactttgggaggccaaggtgagcggatcacctgaagtcagggatttgagaccagcctggccaacatggcgaaaccccatctctactaaaaatacaaaaattagccaggcatggtagcaggagcctgtaatcccagctgttcgggaggctgaggcaggagaatcacttgaacctgggaggcggaggttgcagtgagttgagatcgcgcaattgcgctccagcctgggcgacaagagcaaaactccacctcaaagaaaaaacaaaacaagacatggggcagctgaggccttttgtataccaggcatttatcgagttattcatgtgggccagtttctgtgataaatgatttgcaaataatacccaacttaatctgtattgttatttttatttttacagatgaagaaacagctcagatttgaccaagatcacacaagtaggagttgaggaattggaacccactatgactgactccaaattaatatagtgtttatagccacttacataataatggtaaaggttttatttttttcactatacaatatgtagtagataaatttactgaggaaatgagacagcacgtgacaaatccttaaaggatacacacatgacaggaaggattagaagaggaaacagaaacaggtaacagagaagcagaaaaagtaaaatctcccaaaataaaaatagaaggaattaaaaataaaagcagactccgggtgcagtggctcatgcccagcactttgggaggccgaggcaggtgaatcacttgaggtcaggagtttgagaccagcctcgccaacatgatgaaaccctgtttctactagaaataaaaaaattagccaggtgtagtggcgtgcacctgtaattctggttacttgggaagctaaggcagaagaatcacttgaacccgagaggcagaggttgcagtgagccaagatcatgccattgcactccagcctgggtgacagagcaagattataaagtcttctcaataaaatcgtctcaaaaataataaaaataaaagcagaagttaatgaaatagcaaataaaattgatgatagtaattagctggtgtttgaaaagaacaataaatagaaactcaacaaatctgaggaag

SEQ ID NO: 258532 - DNA, 1159 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcgaaactaccctgcttttcccccagttttggtctgtgaacacatttgggaaattcttctgatcctaccgctactctcttgagagagagaaacaagggaaaaaaaagttaattgcctgaggatatactgctagtgttgcgggacaaatagagacgggagaggccaaacagaattcaggacaaccctttattattaagatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttg

SEQ ID NO: 258533 - DNA, 1135 bp, Homo sapiens
tattccatggcttttcgtgtggacaaatcgggaggtggtgtaaactggtttttggtgaaattcggctcggcctcatgcgaacctatctaggtccgtctctggagtggcctgtcatcgatcgcgccctccatcgctgagcgacacaagtggaaccccccaggactgcattctgcttttggtctgtgaacacatttgggaaattcttctgatcctaccgctactctcttgagagagagaaacaagggaaaaaaaagttaattgcctgaggatatactgctagtgttgcgggacaaatagagacgggagaggccaaacagaattcaggacaaccctttattattaagatgaagaaacagctcagatttgaccaagatcacacaagtaggagttgaggaattggaacccactatgactgactccaaattaatatagtgtttatagccacttacataataatgagggtgttgctatgctttcctctgtacaagctggtggtgtatcaattcgttcttccttaactttgggactgtcacagggttcctgcaattcgtttttgacaatgttcaacataatattcaaggggttttcaactggtgtcttgctgggagatggtgtacaatcaaatgaagatgtctacaaaatgaaaggccctatgagtactgatgaaagttcaaaattctcacattaaataacatttagtcttgtaagacccttgtatgaacaagagaacacacatacaaccaaatgcaaatgaaacacctgcctcccaacaaaatgtgccataaagacaaccagaaataaaatatatattgcacgttcaatatgtactcagcagtgagttaagcagttaacagctaagttataggacattatacagccaaaaaaagttgattagacatgcttctacattttaatctctacatagatgttaaactcatacatatatcctgggacttgttactaccctaatttcaaatagtctgaggattttttaaatccccacaaaccatcaccctcaacactagtcttctgacaacctaaataaaccttccaaattgcctccaacccattatctctaaaaacctatttattccattacttgattttaaaaacagactacaaatatgaccatttg

SEQ ID NO: 258534 - DNA, 307 bp, Homo sapiens
taaagggcacaattaaattttattttgcaagtcgagcctaccttaaaatcagcttaaaaaggtgaaatatccgctggctaatgaaaaaacaaaacctttttatttttcccattacttggttctttttagcaacgatgcattgttctgccactttcaccccaatgttggtttcaggttcaccttagagcaaagtgtaggatgatactgtccattgccgattttctgattttttttttttttttttttttttgagaccaagtctcactgtcacccaggccagagtgcagtggcacaatcttggctcact

SEQ ID NO: 258535 - DNA, 538 bp, Homo sapiens
tcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacaggggtctcactgtgctgcctaggctggtctcaaactcctggcctcctacctcgacttctcatagttctggcgtgagctactgcacctggcctcccccttattatttttttaaacatgaatggaagcatactat

SEQ ID NO: 258536 - DNA, 526 bp, Homo sapiens
tcagcctcctgagtagctgggattacaggcgcccgccaccacacccagctaatttttgtatttttagtagagacagggtttcaccatgttggccaggttggtctccaactcctgacctcagttgatccacccgcctcagcctcccaaagtgctgggattacaggtgtgagccatcgctcctggcctcattaactgttttcaaaagtaaaagtacatggataatacaaagttaaattttgtagaatcataaagaaaagcaacaccttcccatcttaactcccctagtgcctctactccctccacagagacaaatatcttaccagttggttgtgttttcttttccaaactgtatttctaaaatgtgtcaatatctcttccttttattttttattttttgtagagacgggtctcactatgttgctcaggctggtattgaactcctgggctcaagcaatcctcctgcctcagcatctcaaagtgttgggattacaggtgtgaaccatagtatccaacctattatgttttt

SEQ ID NO: 258537 - DNA, 626 bp, Homo sapiens
tgaatagcgtctttttatttaacaatccttatctaacatcaccaaattcacattgcagagaaacttcagaaatataagaaatgtgggaaacacttttacctgtccctcagctatactttttcataacagaatttgtacaggtgagaagcctaatgaaagcccgatatgtgtaaagatctactctcacaatatactcaacattatataatgtatagtgtgattaatataggaaatccttgattttgaaattatcaattatggaatagcaaacaatttgtaagtgaagaaaatccagtgactgtaaatttttttacctcataattcacaatttattaagcatcagaatttatatggaaaaaatagaatatcaattattaataaaaacattaccactaaaattttatttgacttatagagaatagcatatagagaataatcatgttgactttgtgaatgtagaaaagcttttatctattacacgaatctttttcagcatcattatactttcaccagtttccacgtctgttttattaccaagtaatttaaactgtatacttcagattacaaatttcttacattgtgataaggttattgtgaagattaaatgagtttatccaaagactttg

SEQ ID NO: 258538 - DNA, 279 bp, Homo sapiens
cgaccgcacacctggctaagtgtggggcttggagcacattagccagcttttctgagcccggcttccttccttgtggggtgactgtgaagatgaactgagttaacgctcacacagtgtccagcacctgttagatgctcaattaaattctaatcatcattctgatgattaggttcttatgtatgttcattttttcaccccacaaatggtcactgagtgcctcctctctgttagatgtggggcccaggcaggttggtcaaagggccttgtacccccgcaaag

SEQ ID NO: 258539 - DNA, 539 bp, Homo sapiens
atttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgtttt

SEQ ID NO: 258540 - DNA, 221 bp, Homo sapiens
tgtttcctaaattgaacggtggcagaaggaattgggatggtggctaaaggctttcatgctggcgtgatgaaaatgttataaaactgtgttgaaggtttcacaactttgtgactacattaaaaactactggattttacactttaaatgagtgaattggatggaatgtgaattatatacaaagttgttaccaaaagaaataaaaaagaaatacagagttttca

SEQ ID NO: 258541 - DNA, 510 bp, Homo sapiens
caaaaacgtggctcccacatggtgaagttacttacatttgtgacttcaagttcaaacaattcagccttgccacattttcaaagaagggacacgttgccctcctgaattttcattaaatgacaatatttgaaaatatatatttaagccctaagggagtattcaggcaaaaatcaatttaagaagtaactaagatatgcctcgtatgcaactaaaagttagatgagaaggccagtcattcccttctttcccaattcccactgcattacaatttctaagtacatagacttgaacttgaagcaatccaatggacatgtccagtttagccaattattatagtttcctaatgtcctcagagattctgatgattagaatcaggagagggtcactcccgagcttacaagcagcaagtgtttttttaaactggagccactgctaacacgaaagattttctttgcttcatattggcaaacatgtaacacgttcctatgtggtatgaacgtttcagaaaaa

SEQ ID NO: 258542 - DNA, 370 bp, Homo sapiens
tgagcatccctatttatgacctgtttggtaacatgatgtgcatgtctacctgagtttttggatttttcttcccagtcccactagcatattgaatggaaatggaggtgtttggggggtcatggctggtctgtctctttctaggcaggagaggaagagaactgatacctgctgctagggaggattaatggcaagaaatggacttgttttcaaatagtctgatattctaaactagcagttagagagtacctatctcatacaaaacagtcttctaagctctgtggaggtacatactaagaattaaacagcaaccagctcttacataaaactatagtttacaacaggggttgacaagctatagcctacaggccaa

SEQ ID NO: 258543 - DNA, 541 bp, Homo sapiens
gccaaatatgtaaacaaatggcaaattaaattgaggagggagtgtcactttattcttggaataaagtttttgttttgaagtaatacagtttttttatattaagaataacaacatctggagtgctagtttctttttctcattgttggaaattgctattccaattcaatttgacagttttagcactagagggcaggcttgcttctagattgtgaagagttctacatgaattaatatagccaaacagcgcaggttgaacatccttaacttgaaaatctgaaattcaaaatgcttcaaaatccaaaactttttgagtgttgacatgatgccacaagtggaaaattccacacctgacctcatatgatgggtcacagtcaaaatgcaggtgtacaacagtttactctgttcccaagagaaaaataaaattagctgcaggctatgtgtaaaaagtgtatatgaaacataaatgaatttcatgtttagacttgggtcccatccccaaggtatcttattatgaatatgcaaatattcaaagatcaaaaaa

SEQ ID NO: 258544 - DNA, 107 bp, Homo sapiens
cggccacgtcctcttcctcttcctctgcctctgcctcttcctgcaacagcttcccttttcttagatttcaccttaggttcaacatccacaagtagtgtatccagagg

SEQ ID NO: 258545 - DNA, 269 bp, Homo sapiens
cagttatgtcttcagcaaagcctagttaattttttagaccctgagggcagttagagcggagtccaaggccacaggtaaacttaacctttaacatctgctttggtttcttgtgttttctacagtgtcgtaccacattagcattagcacttctggactaaatcctttttgccatctcaggaaaaagaaatgtgtttgcagtttacctttgtattcctagaactactttaaagtctaaaaatgaataaacaaataattaaatgttaaacatg

SEQ ID NO: 258546 - DNA, 234 bp, Homo sapiens
agagccctcatgaactgatcacctcttagaggttccacccctcaacactcttgcactggggattaaatttccaatgcatgaacttcaggcaatgcattcaaaccatagcaacaccttatagttatgacagtctgttttaagctaatgacaacttaaattgaatcacatataacaactctacactttaggagttggagaccagtctgggcaacaaagaaagcctctatctctaaa

SEQ ID NO: 258547 - DNA, 382 bp, Homo sapiens
gcaaaactaacaggaaaacattcactctgcctctagctttctcttcctaaactctgcccttcattttacctggagaacttgccttttccttctgttctccaaatctaattaagcagctgattcttggaggggttgacatttgccactgtggctggagctgaacagcactaatgatccttgttaaggtggggacacttcagagagggctgtccctgttgggtgacaggcagtctaatgagtcctagtgagttcttgagtaggctagggatggtgtcttagtagttcctaaaataatttgactcctactcctcattttgcattgcctggtgattttaattccattaggctgctataggttcctaaccaaccttaaggaaaaaaa

SEQ ID NO: 258548 - DNA, 883 bp, Homo sapiens
atgaaactgaatctgaggaaaagaagaaagctgaaaacacactgaggattatgggagaggggcaagtgcatgaagcttctcaatgacatacagacactctaaaagctcaagagatcaattattcaacttcaagaactgaaatttgaacacagattttgagcttccaaatcaggagaaaaagaagtgttctataagaaatttggacaagactctgcaagaagttaagagcaggtccttaaaggcaactgtgaattaacggagactagttttgagaaaatcagtcctgatttgtttctcctggagttttcttctttatgtgatccttcataaaagctgctaatatgggaaagattgaaatcagcaagtttctggctgtaagctaaaagaggctcttgaatcatatttccgcctgcttagcaaatttctcttgcgacaattggatgttatttggggttccatactagcaggaagaagtacaagcaaagctaagtcattttgagaataaatattatctctctatatatttgtaaatgttattttctttttttttgaggtttatgattgatccttggcatgtgtccccttgtgtattgctctactaaaaatagcctaaaaaagaattttcccctcgatgtggagcttctctttagttacaattctactttctccttcacttgagtatcagtcttcagagaactaccataacaaaggagtggatacagatatacgcaaaaaagtctatgagaaaattagtacattaaatttgtgaaagctcatttaaagtaattttctactaacaattttaatcaaatgtattaatcatatttctatgcttagtgatgttaaataaaaatttaaaaggtggcaatcaataaacagagat

SEQ ID NO: 258549 - DNA, 722 bp, Homo sapiens
atgaaactgaatctgaggaaaagaagaaagctgaaaacacactgaggattatgggagaggggcaagtgcatgaagcttctcaatgacatacagacactctaaaagctcaagagatcaattattcaacttcaagaactgaaatttgaacacagattttgagcttccaaatcagctgctaatatgggaaagattgaaatcagcaagtttctggctgtaagctaaaagaggctcttgaatcatatttccgcctgcttagcaaatttctcttgcgacaattggatgttatttggggttccatactagcaggaagaagtacaagcaaagctaagtcattttgagaataaatattatctctctatatatttgtaaatgttattttctttttttttgaggtttatgattgatccttggcatgtgtccccttgtgtattgctctactaaaaatagcctaaaaaagaattttcccctcgatgtggagcttctctttagttacaattctactttctccttcacttgagtatcagtcttcagagaactaccataacaaaggagtggatacagatatacgcaaaaaagtctatgagaaaattagtacattaaatttgtgaaagctcatttaaagtaattttctactaacaattttaatcaaatgtattaatcatatttctatgcttagtgatgttaaataaaaatttaaaaggtggcaatcaataaacagagat

SEQ ID NO: 258550 - DNA, 583 bp, Homo sapiens
  misc_feature (26)..(27): n is a, c, g, or t
ggatcaatagaagaaaaaaaaagcanncttcagctgctaatatgggaaagattgaaatcagcaagtttctggctgtaagctaaaagaggctcttgaatcatatttccgcctgcttagcaaatttctcttgcgacaattggatgttatttggggttccatactagcaggaagaagtacaagcaaagctaagtcattttgagaataaatattatctctctatatatttgtaaatgttattttctttttttttgaggtttatgattgatccttggcatgtgtccccttgtgtattgctctactaaaaatagcctaaaaaagaattttcccctcgatgtggagcttctctttagttacaattctactttctccttcacttgagtatcagtcttcagagaactaccataacaaaggagtggatacagatatacgcaaaaaagtctatgagaaaattagtacattaaatttgtgaaagctcatttaaagtaattttctactaacaattttaatcaaatgtattaatcatatttctatgcttagtgatgttaaataaaaatttaaaaggtggcaatcaataaacagagat

SEQ ID NO: 258551 - DNA, 422 bp, Homo sapiens
agtatatcttcctaccttataaaagatctaccttataaaagacccgttgaatacttcctgggcctcagggctggattgcaggtagcaggatgtccacctctggtcacaggtaggcatctgatccaaactgggccaatgaaattttctcttaggacttgagagggaataaagaaaatcagtctggctatgatatgtatgtaaactcagaagctgtgggatggccattgctttcgactcatgtggattaagaagaaacaggtattctgtagaaggagaagcataaactaggtccaaagagaactgcttgggctctgatggtttttcagttcttccctccagcctgttcgaatttctgttgttggatattatgagatgtctgtgtcctcataataaagtctctctttttgtttttgctaaaggta

SEQ ID NO: 258552 - DNA, 686 bp, Homo sapiens
ggtaaattataaatatatgctattgttattattccacctcctacacatttttcaattaagtcctgttgtctctgtcctaactcatatccttttatctcacctgggtataccacactatccccttaatttcagaatggatctccttaactccttttacctctatgatgtatccaaacactgtgacactcagaattggtcctaaacacaaatctgagcaattcagggtaattttacaatctactggtgatttctcactgcccatgagataagcttaaaattccaatttggcattgtaattctccaagaatagattcaggcagcagaacagaaagtcatgagaagcccagaggtgcctctatgtacgataattgcttgcaggaggaatgaatggatttaaacattaagtctggtctttagttttacctctatcacaaattagctatgatgtgctccagtggttttagtttcctcacctagaggctgattatcattatcattcgtttctttgcttaaatcctataatctacccagctttcctgccatggctgaaagcctaaactacgcttgttttactttattctctctaaataacttttcaccttactagttgttccttttgcttaaaaatctttctgccccttcccgtcaatatctttctgggggaaactgtaccctctctataatat

SEQ ID NO: 258553 - DNA, 691 bp, Homo sapiens
tatgacaaaaaagcatcacatctagaggacttgataccaactgaagatatactctaccttgggcttctgcccaaggtagaagagataactcttcagatatctctttggtttttctatgaggaaaatagtccatttatgtgtgtagacacaatctataacttttacatcatcattatttaaataaaagagacaataaggtcattacagattagttaatttgaatattttgaataaactcaaatgatgtagtctctctgaacactttcttttccccttagaaaatctctagaggaaaaacatgtgggtctcaccaagaacagtagataaatgccaagtaatgtgaaaagcctataatgtgaaaaatatattctaaagtaacttgaacaataaattatgagtttcagattatgaaatactgaggtaagataggtaatatttaagccagaatgaaggggggaaccagccccagcttctcttctctaatcatattcccagcaagaagggccttatccctcctgttagaaagtccatgcccaagaagtcctgaggctcagaggcagagagcctaagaatggaagttgatattctgattcttggaaaaatagatcatcttagttctgcagttttaggttagagtacaggctttgatcaaggcctgaatctatgtcagaatctatgtccattaattcaa

SEQ ID NO: 258554 - DNA, 127 bp, Homo sapiens
gggctggggggttgaggtttgtactcaatccacttcgtttgacattttcagggagaaaatgatagaatacaattagacgtcctgcagaattactttcctagactgagaaagagctagagatttcttt

SEQ ID NO: 258555 - DNA, 276 bp, Homo sapiens
gtcacctgtacttttgaccgacctgttacaaatcaggggttcccataactgtcttcttgggtttaataatttgctagaacagtttacggaactcagaaaaacagtttattttctttttttctgagagagagggtcttattttgttgcccaggctggtgtgcaatggtgcagtcatagctcattgcagccttgattgtctgggctccagtggttctcccacctcagcctccctagtagctgagactacatgcctgcaccaccacatgtggctagttt

SEQ ID NO: 258556 - DNA, 94 bp, Homo sapiens
ttcatgaagtttatttataaatctttctttatgaccagaactttctatgtgctgtttaagaagtgttgcctgcaataaagtgataaaaatatta

SEQ ID NO: 258557 - DNA, 627 bp, Homo sapiens
agcgtcttcagattttttccagggtcaatctatttattaatatagtcgctttgcaaagtgtagggaaaatgactaataaaatatgtaaacagtgcttcgtgtgcatccgatcaatactcaacaaactgctgctctccaacgcaaacatttccaaatccaatttgatttcaactcgtataacctcttttcattgcttcttattgctgtagccccaaagtgcaagcgagatttcccaaacccgcgcttaaagtgacacaacacgtgagtggtcttcacttggtacactgagtgaggtggggggaaaaagtagttgcaattagaattaaagcttccggtctctgaaatccctagaatcctgaaggatgagacttgtttcagaaattccgggcgggagggagggggagtggtagggagaaggattgcagaaagcgaaacaaaaagacgaaagagtcgggaggtgggggtgactaaggttagggggtgggccagggttttagggtctggccttggacattggccgcgatgcccagcacagcccagggttctccccgcactctcctctcgcatcaaccacctccaccgccaccacttacaaaacaataccagcaacagtacgcaggcttccca

SEQ ID NO: 258558 - DNA, 528 bp, Homo sapiens
catagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggactt

SEQ ID NO: 258559 - DNA, 432 bp, Homo sapiens
caaagataaaataacagtatttgcaataaagtcttgttctggcttaaagccaacaaagataaagagtcaaagtacattaggctagaaacacatttgcctctagaaccatcattgtaacctccaggtaggattagacagtgggacttttgtaattatataaagattacatcctgtattttattggtttaactagatcaaacatgaatgctagtcaatctggctttcaaagagtttatataagttcaatcaactgcacccagccgttatttcaatgacattttccaagtcttttcatttctagccttttgatttttccttaaagaaagataactcttcaaaagcttcaagtaaagaaaacacatcattcatgcaaagacaacacacacgggaagaataaagataaatggaaactagttctctagatcccaccat

SEQ ID NO: 258560 - DNA, 267 bp, Homo sapiens
aagtgagtttgggaggctggcaagtgaagagaacaggcttgggaggcaagtgcaggtgggctgggatccagcctctgccactttccagctgtgagaccattggcaacttatgtaacctctctgagctccagggattttttttttaatttgttaaaaaaaaattagaataactgtttcattggattgttgagattattaagatcatcaataggatatgtttaatatattcagtatttttattaaaagatagcaatttttttttctacc

SEQ ID NO: 258561 - DNA, 723 bp, Homo sapiens
ataaggaaagagaggcaatcaacgggtaagtggcagccagaattcaaatccaggcctgcctatcatgcaagttcctccctctttgctgcaccacacaagcccaccttgtctagcactgggataaattaagagaagagcctggagtctggggatctgaggacagaaagggaaagacattccacatgatggcaggtcagccaccaggaaggcattgagggaacatttctaagagtatttttgttagctgggccttctctacacacggccataccacgcatatacgttccaggagtccaatctctttcctcctgaggtggctctgagctggtgctggccacgagctcttgcaggcccagaggggaggcatggccctagcaagcggcctgagctccagacaaagctgagcctcatgaaaccctgacacgagagctgtcagccctgcccagcaaattctggattgtctttggagtgtgatccacctttggttccagagaagctgttcatctggtgcccaggaagccaggacggtcactcaggtcaccagtttctggtttccccatatatctgaaacctccacctggacaccctcagactcttggcctcctggaaagcaggcagaactagggggtgagtgggaagcgggcagacatactccttatacaccacagccacagatgtccatcaccctggcatcgtgacaaccagagccctgccatgcctgtg

SEQ ID NO: 258562 - DNA, 438 bp, Homo sapiens
gtgggaatctgcatattcagcagcaagagtaaggggtaaagggtcttctcttctttacctcaagcctaatagggtaagttcctcaaaagattatttagagaacctagctgaactctaagttgacatgacaatgaattggtatctggcttccttcttgaacacctagagaccttgaaaaatgaggagctaccacagcagggccaaaagaaagttgctgctgagctgagaagtaattgtcttcccttctaacaatgggcctgaggtgcaaaggtcctgaggacttgttgtgaagcctgccctgtgaccctgcctatgagggcttccatctgagagtgagagtctgtgtaggatggtccatcagaaaaaaaaaatagaagctgagagaagactgagagggcacagggaaagggcaatgtgtattgcccgcatcatagaagt

SEQ ID NO: 258563 - DNA, 224 bp, Homo sapiens
gattacaggtgtgagccaccgcgcccggccagtttaatctttaaatatcattccaacaaagaccagaatggaaagcaatatggcttttttttttaatagttaaaaaaaagtagaggcagggtctcactatgttgcccaggccaatctcaaactcctggggtcaagcaagtctcccgccttaacctctcaagtgctgggattagcaatatggttttaaaatgatc

SEQ ID NO: 258564 - DNA, 480 bp, Homo sapiens
cagagcagcctggacttagtcacttagcgaacatttatggagcacctactgtgtgcaggcactgccctagtgccaggacaggaaaggaacaggtacatctctgtccccaaggaacttaccacctagctaatggaagcagctctcaaacaactaattatgcaattaatttttctgtggattgctccatcatcattgggttataccaaattactgataaatatttgaatcctgcagtgggtaaagtaccatgcaatgtacaaatgggcataccgaaaaagatgaaacagtctgtgcctcccttccgagttcacagtttagctgacaacacaggtacacactcatgccactgaataaccttccaatacaagttcccacttgtcagaatcatggggagctgcagcttccaactttggggatcaggaaaggcttacgtgaagaaagtgggatttgagcacagcctggactgtgattaacaataag

SEQ ID NO: 258565 - DNA, 482 bp, Homo sapiens
ataagtcttctagcctttgctgagtggttctttctttatgttggagtatgcattcaatgcttttgtgggctgatcaaaactctgccttagcctttgcttcctacttgcacagagccttaaggtcagccagagatgagagactgaggccttctcagggactaggcttatatatagacttgcacttgcatggttttctgatgccaggaatatgtcagagcttttcaaaggctatatatgtgcctggttctctgtggctggggcttttggggagctccaactctgttcttctctccttccccacagtgctggctaggctgctggattccataagctactactattctgaggcaattgatttttgaagcaatcaggagctggtggggtggggatgagaatagtacaagttaaaatgccacatatctcactattcttattgagattcaattgatttccctgaataaatgctttttggattactgcaa

SEQ ID NO: 258566 - DNA, 435 bp, Homo sapiens
ggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaacatgccgtgggaagcacgagttgggaaaagatgggaagggaacttgtgccagtttcgccagctgtagccgtgttttttgggaggccttcccgaaacggggcacgtcggctggactgaggagcccggtgctagagcccgcggcctcctggcactaggagccgcaccaggggagccgggccaacccggccacgctcacatcagattacagaagat

SEQ ID NO: 258567 - DNA, 682 bp, Homo sapiens
ggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagaggtaa

SEQ ID NO: 258568 - DNA, 586 bp, Homo sapiens
ggagaatggtgtgaacctgggaggcggagcttgcagtgagccaagatcacgccactgcacaccagcctgggcgacagagcaagacttcttctcaaaaagaagaagtatagtatagtaaataaataaaccagtaatgtattatttattatcattatcaagtattatatcctgtacataattatatctgctatacttatatacaactggcaacatgatgtttgtttacactagtattcccacaatcacatgagtaatgccttgtgctgtgattttacaatggctaggacatcaccagacaataataattttttagcttcgttatagtcttattggaccaccataaatgtactttgtccttgaccaaaccattgttatatggtgtgtgactgtacttaggtgacatgggggctgaaatgaaaggaattacccctcattgctctgagacttgactttggtagagtctttccacctgaagtgtttatgttagttatggaaaaggctctggttttatttcacttgaattatttttcctctcctcctgccagagtcacataaagtgttcttacttggatccttgacaacctgg

SEQ ID NO: 258569 - DNA, 443 bp, Homo sapiens
agacccagagaagatgtggagggagctcagaggttgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagaggctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgcaatcaattttagtaattcaggtgttaaatcacagtcaagcacctatttacc

SEQ ID NO: 258570 - DNA, 399 bp, Homo sapiens
tgtgaaatgttttctgagttcatgcatatttgtgtctttttagtgtttttcttcaggaaaacaacttggttggttataaaatttgtttttgttcaaaagctgtagatttttttttttaaatttaacattataaaagtgaggctaatctgtaattttcccttctccctctaccccattatcctgaaagtttatgattgttttctttattattttaatgttaaaaatttacccaggagtgtctaattatggatttattttcccaggaatgaagtgaactgtttcatctgtgaccccgaagaatcttcaaaatttagatacttctttatttataagtttgaattttgtcagttgttttggtctcttcctgagagaaaaatagaattcttagtttgattctct

SEQ ID NO: 258571 - DNA, 327 bp, Homo sapiens
gaactgataacttgaggcactatgtaactatgcttcaacacctcaaaaaggctccagcaggcacttctgaaaatgatttttaaagcccttttttacttgaatgctgttcaacattctcacaacttggcttatgtttttatgctgaacaaatgattcatgaccctttattctgggggctggattacttgaatccaaagtgatgtgatgaataacaaggatctaggcgttgttgcccagttgatagtcacaaaatacttggccttaataagtcaggaattattttccccatatttctcgaattacattaaagaatataaggtttttaaa

SEQ ID NO: 258572 - DNA, 839 bp, Homo sapiens
ggaaaaatgcatttacagaaagtcccaggacttgagaagcaagctcaggtttttcatagtgatgtagagaagcataaatgttcattaattcagttactcattctaaaaatattaagtacttactgtatgccagttattcacctatgaataagacaggcaaggactatggagcttatagtctttccactgaagaccaatactaaggaaatatttatgagtgatatacattacaaaagaacaaacagttcttttcagctatttagagaatgcagatacaagttgagttgtaaagcaaacatttctaggtgataataataaaagcattaatttttcattctctcaatgttttggatcaggagaaagagacccagaaaaggtctcttatccaaggttatataacaactggtatatctggtacctcggtcccctgcctcctagtgtaataatatctgccataagaaataaagcaggaatgtgaaagagaagaaagtcaggcaggatgcctagaaagttcaaccagacactggatttcagtgtagtctatataacaggaggaatcacatttttaaaacttcttttatgcttgttttatacatttcttttcagtttcttttagcatttactaaatctttcaggactttgctaagttccatacatctacaaaatttctaaacaggagtcttatgtccctggaagcaaactatgttggtactatggttcctaaatctcatctctacaaaaacttttcagggttgtatcttttttcttttttctcggtaaagaaggttgttttctttaattaccttgaatttaataagtacagtcttatgattgctgac

SEQ ID NO: 258573 - DNA, 396 bp, Homo sapiens
gctttgacagttgagtttggagcctctgcttgtggcattgtgctaaagcaaaaaggaatggaatttgcaatgagagagcctttcaagttcaggctcagcctttagctgtgtgaacttgaaccactcacaatttttctgaatctcaatttcctcatctgtaaagtttatctaatatgttggtggtgaggtaatcatattattatctcaaataggagattgtatatgaaagggctttggaaaggcaaatcccattatttgtttaaatcaattttttcccctaaaaaagatagctcataaaagaatgtgaacttaatctgtatgtgtaatttctttcaagtcctatctgatgttgcttgtgactttctgagatttcctttggcttcttaccagtttggc

SEQ ID NO: 258574 - DNA, 266 bp, Homo sapiens
gcgccagcctgttggtacccgggaattcgcggcgcgtcgatgaaaaccagagagttaagtgcacaagtacatgacccagccctgcaacaaaggaaagatgagtgaggtttttgatctccttaacctaggagcttggggcttaacatccacatggagactggatataaacgccttgtaccctaataattcaggattctaacttgggccctgcataaaacatgaactagaaagaacaatgcactccccctgccgcccccactccccac

SEQ ID NO: 258575 - DNA, 277 bp, Homo sapiens
gttaagctctgggggagtcaaaagttatacatggatttttagctgcagggaggctggcacccctaacctccacgttgttcaagattcaattatattctaaaatttattctggtgatgttgcagaattctgtgaatatactaaaaaatactgaattttacactttaaacaatttcatgaattatgaaaaagattgtgcaaatgtccacttttataaaccattgaaaattttcttaattggaaaatgattttataaataaagttgcattattgctttgt

SEQ ID NO: 258576 - DNA, 409 bp, Homo sapiens
acaataaatgtaccattctggtacagactttgagagtagggaaggttgtgcatgtgtgaggacagagggtatgtgggaattctctgtacttttgctcaactttgctgtgaacctacaactcctgtaaaaactacagtttattaatttctcaaaaatggacaaatgatataaacaattaaaaaaaggaacttagatgtccaataatgatttaaaaacatatttagctttgtaaactaaaacaaaatactgtctttttctcttggaaacaaaaacaacaaaacagaccataatcaagtgttagtgaggatttgtggcaacgggttttcatacattgctagttggaatataaactggtataaccaactgggagacaatttgacagtactctgaaatgaattatgtatatatt

SEQ ID NO: 258577 - DNA, 645 bp, Homo sapiens
cggatcatacaggcattaaaggaacattaaagaaatactattaacagcttcctatcaacaaatttggtgatttagatggaatgaacaaatttattgaaaggtataaactgctgaatgttgtttaaaaagaaactgaacacttctatacttattagaaaaaaaaatcaatttgttatttaaaaaccctcccacaagtgtaaactagttcgaccattgtggaagacagtgtggcgattcctcaaggatctagaactagaattaccatttgacccagccatcccattactgggtatatacccaaaggattataaatcatgctactataaagacacatgcaccacacgtgtttattgaggcactattcacaatagcaaagacttggaaccaacccaaatgtccatcaatgagagactggattaagaaaatgtggcacatatacaccatggaatactatgcagccataaaaaaggatgagttcatgtcctttgtagggacatggatgaagctggaagccatcattctgagcaaactattgcaaagacagaaaaccaaacacttcatgttctcactcataggtgggaactgaacaatgagaacacttgggacacagggtgggcaacatcacaccctggggcctgttgtggg

SEQ ID NO: 258578 - DNA, 296 bp, Homo sapiens
aggcccatcagttcttaagtttgagaaacccctaatatagagccatttctcagacgggagagcagagttccagatagggaacatgaaatgtccaacctcatgcatctatcaagtgcccacaagccagcacaggcagtgtggggtaatgataagaactcacttaggatcgggcatggtggctcatgcctgtgatcccagcactttgggagactgaggtgggcggatcacttgaggccgggagttcgagaccagcctggccagcatggtgaaaccccatctctgctaaaaataaaaaa

SEQ ID NO: 258579 - DNA, 491 bp, Homo sapiens
aaattagactttgatcactgacctaataatcttattttctcaaacttcagtgaatatatgcaagcccttgatgactcacatattttttgagttatgatttataaggtggaaagtagttcctgataaattcagatctgtgaatgtaaaaattagttaaaagtagtagctaaaagtaaggtaatttaaagtacctcatcaaccttttgtatagcaggatataactgttcatctcttgtcctaactcatgtttgtatagtctttaaaaaaatcatctcctttaaaattttgcacattctacttttcgtcctggcctaacatggtacgtgttatgtttggaggaaactaatataaaataattcatacccccaaacaaaaaagtacagttagtatatttatttcatttactatttgtaatgtcttttgcatccaagatgatttttccaagtttataatttttttcattatgaaagtcatacagatatacttcgaga

SEQ ID NO: 258580 - DNA, 602 bp, Homo sapiens
aacacgagctgagagttgaataaaaaataagtgaagtagttgttcattgtcaggtcaggtttgaattctctcatacttgaaatccctgcaactgtgaaattgcctgtaggaattgcaggttgtgctaaacaatcaaacgaattggtaggttggctcccataggcaaaatcttgaggctgtttggggctccaattttctggggaagcaaattgcattgcactttgttttattttaaaaaatgatgtgaaaatacagagcatcacagcacagacaaatatcttacaccagttttcacaataaaatccccaaatgtgaaagctctccctttttgcaaaggcactttggaagcaataatgtttgtgtgcatagttgagtttatcagagtatactgattttttatcccatgaggttttcaaggaaagtgcagctggtcaacctttagtgttttctttgccacagggtatagttctgtttctgtccgctcaaatacagtctttcaggaaacgaattctctgtaggataccttaaaatgtctttgtgttgtaacacagggtagggggcagtatgtttaataggttagtgtggatacgtgggtcctgaaa

SEQ ID NO: 258581 - DNA, 723 bp, Homo sapiens
gtctttggttctttaacatctactttttgtcatgctaattctgtatttcagacaatgtaatggcagctgaagaacaaattaatacggtctgctataggtttaactggctgtggaaaattctgtgaatgaatcaagcagcagtttttcttcagattctttaaatttagggaatcctatttctagtttccgaaaggagaagtgaatcattctgcgtagtgttttagctgaatatgttaaatctgtgtattaaatttaacataatactgtatctacagttaaaaaaagaatagtatttagataacaattaaactgaattatctcatatttccctctttagatgacaatagcatttaagaacttacataaaatcctctttgcttcataatctgggacatatgtactctctcagctggcagtgtagtccttactaatgtttatgttaatagaaggatacataaaagttcctgaaagtaccataagtgtcttttagtgtttggtgtcattgacatattaacaaggagtctgaagatgagtaacacacccacatctgtcagtgccacagccggcacttgagcgacacaccagcacctcagacagagcatacagcttctttgctggtgcgcttgtgttctgggaaggagcaaatgaaatcattcacaaatcaggaattcctggcacaatatagaatcaggaaagctttttctagatgtgattgtaagtgat

SEQ ID NO: 258582 - DNA, 246 bp, Homo sapiens
ggtgaggattgaaaaactacctatcagagactatgcttattagttggctgacaaagtaatctgtatatcaaacccctgtgacatgcaatttacctatataacaaatctgcccctgaacctaaaataaaagttaagaaaaaagaaccctttccctgcttcctgacacatcctaaaatattgtgtcttgcataacagatgaccttgaaattcaaagcatggcttcaaaataaatagttttattacact

SEQ ID NO: 258583 - DNA, 1140 bp, Homo sapiens
gaatgtcatccctcactcacagaccctcagacggaaaatcaaagacatcctgggaggagcttcttcccaggaaccctcccgaaactccccgaaactcctccgaaattatccagaaagtccgttagggagattctcattcaacaaatatgtgtttcctgtttgctaggcactcttgctgaggttgggaatacaatggtgaatgagccacagtccctgccctcagtagcacacccaggggagggtcagctccacccgcccagacagacaccgaactggagaggataccacccctaacctctaccccagatacacctgacaagctgatcccctgcccacacacccagcaggtggctccaaggtcagagcctgcagaacacagacgcaatagagaaagactcagcgctgtggaaagacacccccacctacccacgacagtggccacagggccacccccagccaataacaccattacaaagacacgtgccttcagataatgcctgcagaaacgtgcatgctccaagcactctagaaatcccgtctcaagcagtgagtgccccgacagccacagccagaggagacacactcaaagctcctggggtcactctcagagggtctctgagccacgaacccacatccaggcacacacagagtcgtcacagagacacagtatggagtccacagcagcacgaacataggatacgaacgccgcaccacaggacagatctatctttagggagactcagagaactttttatttttaatagagacagggtctcgctatgttggccaggctggtcttgaactcctggcctcaaagcattcctccagctttggcctcccaaagtgctgggattacaggtatgagccagcacactaagcctgattcagagctttgaaccctagacatatgaacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtctgtattaactgatttg

SEQ ID NO: 258584 - DNA, 265 bp, Homo sapiens
gtgtgctgggctgatttagaggatcccgcaggttatacagactcagcttcgagttccaaaacaccaatgccacctccagaaacagagacaagcctcccaagataggctcaacctggtccagttagtgaccagcacaggagaaaaatctgtttcactcctcaacccagtgtatagttagagacatatataccaccctaccccctaccaaaaaagattttatcctcctttttttaatgctatttgtgagtctgtattaactgatttg

SEQ ID NO: 258585 - DNA, 867 bp, Homo sapiens
gcaggtcagcaggtcagcaggtccgggagccccagtctcccggaacctggagggattcttgaggggccaagattagatgtggattaaatgccagccgtgtgagaatttgagtgtggctcgcagtctgatgcatcttagagtgtttccttcctctaaaacttttggacaactctttcctctttttaaaaataactttttcccccgaatattctcattttcattttaaaataccataaagatagatttggacaccaggcacaagtttcataatttggcttgaaatgaatatccagagggccttttacagaatggaggaaactaactagggtgtcctaatgtctccaagaacctctgcgcaggtgttccaccaaagacctagcccggtgtacctcttactttcctgctaaggtatttcttagttcatacccctgtggaacgtgaaatgtgtttcctagacactcagggcatagcggttcaaaagaacttttaatgtgatccttgacgagacggagtactagaggaaagtaacaaaagaaaagggcccgtgagtttattatgcccccagatgtttttttctggtggcataacgtggtttaaacaaggtgccggtactagctactattcattttaaaatctgggtctccagagagaaatttcagaaaggaaaactttgtcctttttcataaacctagagcagcgattttccctctggcctcactggaataatgggtggcacatgggccaggacgatgatgctggctggcgaaattagcaaggatctgctgagaaatactttataaagtcttctagtggtatttcctgtctgctcaacgtgtgttgtgaaaggtctaagaaatttaacttcat

SEQ ID NO: 258586 - DNA, 307 bp, Homo sapiens
actaggtaccagcagcaacttcacagttgtggcaaccaaaaatatctccaagactttgccaagtgtcctctggagagaaaaccactcttagacaagaaccactgctatacagcaaaaacattcaactaagatgcttttggttttgattgtgtgtttactataagactaactgaccagccagcattgactttgaagcaattatcagattgtacttgaacatgaactttgtgcaaactggagagcacggctccaggaagattcaatctgctggagcaggtccgggttaggcatcagcaaattggttttg

SEQ ID NO: 258587 - DNA, 403 bp, Homo sapiens
tgcctttctcactcctccctcctccttcttcccttccttcctttggaataaattagctcaaataatagtaaattattcctttggaataaattagtttggaggattctgatagattaattaccgtatatgtattcaacattaatatctttttgggtatgataaaagagaatgcacagtgagcagcacatcaggccagaagtgcaaagaccacctatttccatggggcaattaggctatctccttattgtttggttcttggtttacatttttttctcatttgtagatgataaaactataatagtgactgagctcagtactttgaaatctgtgtgtgttgacattaaaggctctgagaagtcttgcagtaaatgaaaatgtttcaaagctaaattcattttagtaa

SEQ ID NO: 258588 - DNA, 660 bp, Homo sapiens
gacctcaggtgatccacctacctcagcctcccaaagtgctgggattataggtatgaaccaccacacccggccttgttctataattcttgttccttctcccaagagctgtaagatgggccccagggggcacccaagaccaggtccaaaggggacaaaggaggggatgcacagaggtaggaagccacagtgaacctctctcgaagtatttgctaccacgtgtctgcatgcagcccgggcgaggctgtttgtattgcatatatgaggtgctgggtttttctttctttcttttttttttttttttgagacggagtctcactgtcgcctaggctggagtgcagtggtgcgatctcggctcactgcaagctccgcctcccgggttcatagcattctcctgcctcagcctccccagtagctgggactacaggtgcccaccaccacggctggctaatttttttgtatttttttacatcaaacaaagttgctcgcatacctacatgttgcacacaactgtctgtgcttggttctcactgacctgaacactaaatttgtgtacatcatggatgctggaagtaacctaaagaagtgttcctgtccaaccaactggttcagtgtctaatgccgtatcctactttgggagcccctgtgggaggttattttttt

SEQ ID NO: 258589 - DNA, 390 bp, Homo sapiens
caaagattagatatttgaaagaccactgtaaaacaagaatgttgttctcagcacatgacaaaattaagttcaaagtgattaaatgacttgcccaaaataagcaccaagtgaaaacacagccaagatttaaatgcaaataaaccaaattagtgtgtttcaaactgcatgttcttttcattgttctacacttccttaaagatgctacagagatgagtatttgttggtaacctgttgtatttgtaaatgtttatggggatatatatatttactgcttctatttgcataaatttgaattttgctgcattttttattattatggaaataatatagttccagatccattcttttcaaatgcaatttttaaataagcagtaagtggacattttcatt

SEQ ID NO: 258590 - DNA, 319 bp, Homo sapiens
atttgacggtctccatggtactccaaatcaagttagaattaatttgaaactcatttctctttcaggtctaggtctgataattttcattcatttctttcatggacatggtgactcttttcttgccatccttaaggagaaaagccatggacactacaaaatctttgaggtttgaagtgggaactaggagattcaggcttgaagatgaactagaattggagacagggtaggggaaatatgaaaggccctcttattgcaagttttaggagccactaaagcataggctttagattcttttgatagtgatgtcactattgacatg

SEQ ID NO: 258591 - DNA, 490 bp, Homo sapiens
atgagctaagacatagggagacgttggaaaggcatgattgtgttttgaaatgtgaggacgtgagatttggtaggggccatgggtggaatgatatggtttggctctgtgtccctatccaaatctcatcttgaattgtatttaccattatccccatgtaccattagaggtacctggtgggagctgagtgagtcatgacccatgctgttcttgtgatagtaagcaagttcttatgaaatctgatggttttataagggacttttcatccttttcttggcacttctctctcctgcagccatgtgaagaagaacatgttgcttccctttctgccatgattgtaagtttctggaggccttcccagccatgtgcaactgtgagtcaattaaacctcttccctttataaattacccagggtcaggtatttctttgtagcagcatgagaatgtgctaatacaaatgtttatgccttttttgaagttttaatgttcttagt

SEQ ID NO: 258592 - DNA, 372 bp, Homo sapiens
cttatattaaccaaacctctgtcacacggccctagccaactgccagaaaaaaaaaaaaaaaaaaaaaaaaaaaaaagaatggaaaaagtcttcctggggcccttgaaagaggaagcaatatagtaaattcataatagggtctttgccctcagaaaccaaggaagaaatatctcctgctaatgaaaaaaatattaattccattgacttggaagtcaaaattgccattaatgggcccctcataacatagaagaatgggccaaaaaatgacatgtaatattgatgcactgattgatcctgatcatacagaaatgttattattgctttccaatggagatgcatgttgggaatgtagtgtgtttttaagatgtcttt

SEQ ID NO: 258593 - DNA, 916 bp, Homo sapiens
cctcatttgacagatgaagcatttggggctcaaaggggttaaggactgtgtgtttatagattcctcaggcgctcatggtccagagaacatcatgaatcatcttggctccataatttttggggttacagatacttagagagatggacagggggtgtagttaccacactggcctccaccatgtggctgaaggccatggcttgattagttatttcttaatacacatctgctggctgcaattgcaagccgggggtgtgagctccaggcagaggcagagggtggcaggaacttccagagacttactggcagagcatagattagctgttctcccccttgacaattgccttgggccccttgtgttccagagggatggatgatccagatgcaaaatagagtgaagatgaagatacagattggagagaaaatggactgagtccatagggaacttcctttgggatattccatgagctggctgctcactccttctctctttcccaacaaactacgatgccctcaataaactatatgtatttaccaagcaaatgtgtcacgcacactttgagactcttgcgatactagcagaattagatattctttctctgtgcccctaagataaatagatggtgaatatcactgtcagggtatttgctgtgttacctgtgtatgtttgtctctctgcctttctctgtgtgtgttcattgggagctacgattatgttgttattatcatgaatcttcgtgttcctaatgcttaacagagtgcttaaaaatggtttttcaataaagaaatgtagttttggataaagaattgaggaaatggccataacaagcttgtgtactgttatttacagggagacaaacagatccgaaaacagatctgtcgattaaaaaggctgtgacataagtctatgccagactgc

SEQ ID NO: 258594 - DNA, 222 bp, Homo sapiens
aaaaaaaaaaaatgccaccgtgactggtagtattaaaaagcttctcatgctgggtgcagtggctcatgcctgtaatcccaacactttgggaggccaggaccagaagattgtttgagcctgggagttcagggaccagactgggcaacaacgtgagaccctgtctctgcaaaaaattaaaaaattagctaggtgatcacacctctgcactctaacctgggcgac

SEQ ID NO: 258595 - DNA, 754 bp, Homo sapiens
ttaaccagtttttacatgtgaaggtatatgcatatgcataatttgtttatataaagcatacatacacacatacatgtttgagtgcatatgtttgtgtatgtacatgtacgtatgctgttttgcattaaaaaaaaactctgaatcagacattgtttaattctaagcctagatagttttcctaaactgtgttttctacatctttattttgtggtgtcacaataggtaaccatattcatttcctatactaaaccccgagaatccttatttctctggcattttaaggttaccagagaacatcagacatcatggaaaaattcactaaaaatagtattatgaggattttattagtagcttattaaacagaggaaaaagtacttgtatcatctgtattcagcaagcaaaattgttaatcatgattaattttagaatttgaattataagtggcttaatttaaaaggaaaaacttaggctgggctcggtggctcatgcctgtactcccagtactttgggaggccaagacgggcagatcacttgaggtcagtagttctagagcagcctggccaaaatggtgaatccccatctctactaaaaatacaaaaaatagcctggcatggtggcacgtgcctgtaatcccagttactcaaaaggctaagtcacaagaattgcttgaatctgggaggcggaggttgcagtgaaccaagattgcgccgctgtactccagcctgggtgacagagtgagaccctatctcaaaaa

SEQ ID NO: 258596 - DNA, 2666 bp, Homo sapiens
  misc_feature (1021)..(1021): n is a, c, g, or t
  misc_feature (1762)..(1762): n is a, c, g, or t
  misc_feature (1894)..(1894): n is a, c, g, or t
gaattccggggtgtcaccgctttcgcttctgcttgatatatgtttaatataccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcagatttggtgagtcttgaatgcccctgaaaaccattctgctccatttcaaaagtacttcccagtcttcgtattttacctaaacgcaaattcactgccttggagagtgtgagtccaagaagaaatcctttgggctatttccttggcttctctccatgacgattcctgactcgtggccccggcaatcttgggaagacatcatccagcttcttcagtccagaccctgggcaccccccttttgccaggatcgtccccacccagcctggacacattgactgaactgttttctaggacactgcactcagcaagacatggtggtgagccctgactctcagtcttcatgattgaagaactcttttgtacaacacaaagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatcnttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgngggctcagcccatcgcatggggccagccgggtctctttcctgccactcagcagccctggccaactgtggccgggcagtttccgccagccgccttcatgcccacacaaactgttatgcctttgccagctgccntgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacaca

SEQ ID NO: 258597 - DNA, 2543 bp, Homo sapiens
  misc_feature (898)..(898): n is a, c, g, or t
  misc_feature (1639)..(1639): n is a, c, g, or t
  misc_feature (1771)..(1771): n is a, c, g, or t
ataatctaattaaggtagcataatatagagccagaagtcaggtggtatttacaaggtacagaagagatcttggactcaaaaggcatggagtccagtcctatttagctggaaaatctgtggcttatatcatctccaaccatggtaaaatgaggacagcaccatgaagatgaaatgaaagcacaaaagagaaggtatttggcaaaccatgacagtcgttgttagaaaggaaatgtcaaatgagtgcacaaagagggacccgaggggaccctcctaaaaaactgcaagatcctttcctttcactgttgctatgttctgacaaggtttgttgtcttcctgttaaatgggaggtgagtgtggagtggagaaagcgagttgtttgggcctcaggcctcaacctccacttgaagcctacacaagctcacctttgctaccctgcagagaaggcaaaaggagttaatgatgaaatgtcagaaaggcccttgggagcttttagaaattctcaccagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatcnttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgngggctcagcccatcgcatggggccagccgggtctctttcctgccactcagcagccctggccaactgtggccgggcagtttccgccagccgccttcatgcccacacaaactgttatgcctttgccagctgccntgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacaca

SEQ ID NO: 258598 - DNA, 1546 bp, Homo sapiens
  misc_feature (898)..(898): n is a, c, g, or t
ataatctaattaaggtagcataatatagagccagaagtcaggtggtatttacaaggtacagaagagatcttggactcaaaaggcatggagtccagtcctatttagctggaaaatctgtggcttatatcatctccaaccatggtaaaatgaggacagcaccatgaagatgaaatgaaagcacaaaagagaaggtatttggcaaaccatgacagtcgttgttagaaaggaaatgtcaaatgagtgcacaaagagggacccgaggggaccctcctaaaaaactgcaagatcctttcctttcactgttgctatgttctgacaaggtttgttgtcttcctgttaaatgggaggtgagtgtggagtggagaaagcgagttgtttgggcctcaggcctcaacctccacttgaagcctacacaagctcacctttgctaccctgcagagaaggcaaaaggagttaatgatgaaatgtcagaaaggcccttgggagcttttagaaattctcaccagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatcnttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggtatacctgtgaatttatccttgcgctggagatcgggccttcaaataaacacatgtaaaaactgacagtcaggccttctcttcctgctgccaagtagaaataaacgaagatgaaagattcctgtgtaaattacaggacccaaagcaagccattagaaattattccttattctcttaaactctagacatgttagatgaagtgaaatctcgaatccagagaaagatttcaggggtggaggacccaagaaacacaattgcttttgctgttgttaacagtgcgggtggaggtgggagtggctctaaggattttgacttttttgtgttttttctaccttgatggcccacca

SEQ ID NO: 258599 - DNA, 240 bp, Homo sapiens
tgatgacgcctgcatcacggactgcatggtcgggatggcggagtgaccacaggctcgggaagtgacttgggacggtcactgtggctgagttagcagttggctgcttgttgttttcttccgtttgtggcgatcctttctttcccagatgacccctgttttgtgacgttcattcttcccatttgtcattgaaagccgttgctgggataacgctctaataaaaaccagtgccagaaaagatgc

SEQ ID NO: 258600 - DNA, 558 bp, Homo sapiens
  misc_feature (513)..(513): n is a, c, g, or t
ctgagatgaaggtgaaggtgtcagtatccaaagactggaaattctaagagaaatatgtcgcttggagaaagccctttaatttaaaaaaaacagtatatattttgctaatagttacagtaaaaacagataaaaccaagagaacatggccatcattgttcaaggcctcatactctctgatgcaaaaagggtacatgtgcaggatgtgcaggtttgttacataggtgaacgtgtgccatggtggtttgctgcacctatcaacccatcacctagtgaaaatggtgataaagtgaaggacatgctccagggaatctgctgatgtctccaaaatgtcatcggcaaagcggcggagaaaaatgagaaaatcacccaggttatctgcaaaaaattctgaaaaagaaaatattcactggaattagccaaacatctgtatatctgtactaataaacaacatttaaattcctttcaccctacttaatgaaggttaaaaaaaaccctaaatgttttgttggtacnagagatggtcgttaagtcaataaatgtaaaatctcctttaaatgt

SEQ ID NO: 258601 - DNA, 611 bp, Homo sapiens
  misc_feature (566)..(566): n is a, c, g, or t
ctgagatgaaggtgaaggtgtcagtatccaaagactggaaattctaagagaaatatgtcgcttggagaaagccctttaatttaaaaaaaacagtatatattttgctaatagttacagtaaaaacagataaaaccaagagaacatggccatcattgttcaaggcctcatactctctgatgcaaaaagggtacatgtgcaggatgtgcaggtttgttacataggtgaacgtgtgccatggtggtttgctgcacctatcaacccatcacctagcctaaacagtgacagaaccaagctttcagcacttcacctttctatgcttccagtgaaaatggtgataaagtgaaggacatgctccagggaatctgctgatgtctccaaaatgtcatcggcaaagcggcggagaaaaatgagaaaatcacccaggttatctgcaaaaaattctgaaaaagaaaatattcactggaattagccaaacatctgtatatctgtactaataaacaacatttaaattcctttcaccctacttaatgaaggttaaaaaaaaccctaaatgttttgttggtacnagagatggtcgttaagtcaataaatgtaaaatctcctttaaatgt

SEQ ID NO: 258602 - DNA, 131 bp, Homo sapiens
  misc_feature (129)..(129): n is a, c, g, or t
  misc_feature (131)..(131): n is a, c, g, or t
caccacgttctcctgcccccgtcaccttgtctcttctaactcattagcctttccttcctttgtctgttttcttctcccagctggtttaagttcttgatcatccctggcaccacctaccctaaggtcttnan

SEQ ID NO: 258603 - DNA, 127 bp, Homo sapiens
gctgaatgtctctctccccctacaatgaaaaaaagatagagatgtcacctgaacttgccatttttgatttggccccattcccttaactttacatccatctaatcttttttttttttttttttttttt

SEQ ID NO: 258604 - DNA, 655 bp, Homo sapiens
tagttcgttagtggcacgagaggaaattgcatttattataattgcctctaattgcaccagattagtgattacaattattgatggcagctgattattcattaggcatcaaatcaatccccgtgcttcttcattactcgaaacagtaactctgatgagaggtctaaaggaggccatgtccaccctttccactaaatggcaggctgctccccgtcctgcctcgaaacaaacacctgaaaataatttaggacttaaagtgacagagaaccatccctcgccttccgccaggtgtggtgattcatgtctgtaatcccagcactttcggaggccaaggtgggaggatcacttgaggccaggaatttgagaccagccagggcaacaaagttgagacactgtttctaaacacaacacaacgaccgcacaataaacaaacaaaccattgtttggccggcccagcggcctcaagagaaacttcctcaaacacccacgcccgtggaggctggcgacccaggagagtaacaacacaggggcaaaacgggtccaaagaaaccggcagcaaaagcgatggactacacaaaataaaaaagccgggggaaccgacggtgtaaaactaacggagcgggcccagggacgcaagggccacacgcgaaaataccgg

SEQ ID NO: 258605 - DNA, 384 bp, Homo sapiens
tagttcgttagtggcacgagaggaaattgcatttattataattgcctctaattgcaccagattagtgattacaattattgatggcagctgattattcattaggcatcaaatcaatccccgtgcttcttcattactcgaaacagtaactctgatgagaggtctaaaggaggccatgtccaccctttccactaaatggcaggctgctccccgtcctgcctcgaaacaaacacctgaaaataatttaggacttaaagtgacagagaaccatccctcgccttccgccatgtaatgcctcatcccgaacccagcactaactgatgaaattacggaggctgttaaacatcaccaaagactatttggaggtcccagaacgctccagaattg

SEQ ID NO: 258606 - DNA, 288 bp, Homo sapiens
caaaagcacatctaacaccaagaggcactgctcgtggggagggtgcagcgtggcacatatggaatcccggagctgcaggcgaacatctctcaggcaaccagtgcgtcgcgttctgccaggtgccctcacatgcactggggccccagtcagtttctttaagcccaatccggatcttccatcctttttgcttccaggcgatatttgtgatccactgctgtctcttcgtggtgtctcctgatgacatctgcaggggccccctgtgaactctttctagttaacaggcatcac

SEQ ID NO: 258607 - DNA, 323 bp, Homo sapiens
gaaccctggttttctaatctgtgcatgggaataataaaaaataataatagtactgtactctaagaggaacaggggagtgtgagtttgtcttttgtttgtttgttcattttcagagagacagggtcttgccgtcacccaggctggaattgcagtagtgcagtcagctcactgcagcctccaactcctgggctcaagtgatcctcccacttcagctactcgggaggctaaattgaggatcgcttgagccctggagataaaggctgccgtgagccgtgattgtgccactgcactccaacctgggcgacagagtgagactccatcac

SEQ ID NO: 258608 - DNA, 313 bp, Homo sapiens
tagaaagctggtgcttcagttacatgcactcaaaggagaagaatctactttgaatggaaagctcccgggtattcccacaccttctttgtttgtctaaggccatggctctgcagagctgcaataaacctgcgtacccaccctgcagaaggactgggccacagctagcttgtaaaacaaaactaagtcaccaaatttatttcctttaacacagtctcttagcagaacctttctatgctgactgtggccttggctcaagcaacagcaattgcagctcctgctggttctactaaggaggtaaaaataaaggcgactc

SEQ ID NO: 258609 - DNA, 559 bp, Homo sapiens
aaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 258610 - DNA, 655 bp, Homo sapiens
aaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 258611 - DNA, 683 bp, Homo sapiens
cacgtatatgggaaacggccacacaccaaattaaaccattcactgacacccgggcacacccattttcaccactctgctcttgcccgtgccattgcctttgcatccaagggattcttccttctgtggcaatctgtatgacatccttactaagaaggcctccctcagtgcccttggccctctcacagccctttccatggccttctccactagactgtgaggaacccagtgtctggaacagttcatggcattgttgttagtgttgtcattttgttgttaagccttctgctgtcagtggtcatttcatatgtttgcatatttacgccctgcctctttttggtatgcagtgtggaccctattgcacggctacttgtgtttcagtggctttgtcctattccaccttctatgccacttactctgaatgcctggcacattggtaggtgcccaataccaacttggaaagtgaatgaatttgttttctcattaccttttgaaatgcctatacagatgttcctccacttatgatggagttcattctgaaaagctcatgataagtagaagatattatgtcagaaatgtattttattgtattttttattttttaatctttctttctctttctttctttctttcattcattcattctttctttctttctttttctttctttcctttcatctttcttt

SEQ ID NO: 258612 - DNA, 279 bp, Homo sapiens
tttaccaaaccatttgaaagtaagatgaaaatactgatattttgccccaagtactttttataatgtgatcacaatatcctcatttccaggggatttaacattacagtttgtattcagatttctcagttgtccccaaaatgttctttatagctctttgaggcgggtttattcagtctaattaaggattgttctctaatctagaacattgtccccacttttttcattctttcatgccattgcacgccagcctgggcaacaagagcgaaactccatctcaaa

SEQ ID NO: 258613 - DNA, 417 bp, Homo sapiens
aggagtttgaggctgaaatgagctatgatcacaccaccacacttcagcctgagcaacagagcaagaccctgtcttgaaaacaaacaaacaaacaaaagaggttttgcagcataaatgttttgacagaactaataaagaatgtgcctctgtctggccgggcgcagtagctcatgcctgtaatcccagcactttgggaggccaaggtgggtggatcatcaggtcaggagtttgagaccagcctgaccaacatgatgaaaccccgtctctactaaaaatacaaaaaaattagccaggcgtggtggcacgtgcctgtaatcccagctactcaatcgcttgaacctgggaggcagaggtggcagtgagccaagattgcaccactgtactccagcctgggcgacagagcaagactccatctaa

SEQ ID NO: 258614 - DNA, 641 bp, Homo sapiens
actgaggccacttaattgagccttagcagtgtttgtatacacagcaattactttttaaaaatctaaatagctgtttcaaagtgaagcagaaacattaataattcttggacccctccaggggatacttctggactttaaatttagagcttagagagttcctgagaatgattcaaaatatgtttgtttccttttttgaataacagcagttaaatatctaagtcaaagatgtttgctataattctaattttaaagataacatttattgactttttctagttataaagataacacttttctgtacataacttaaaattcttatcatttcatcctaaaaagagttaacagtttgtgtaaaactttattttttatagaaaatatatatgtttaagttggattcatataacatatgatcatatatttgtttatatatgtttaaattatatatgcttagacttatgtgatatacaattttataatctgattgttaaatttaactgtatgacaaacttatcttgtcatcatattttctgtaaaatgttattttaacaggtgcataatgtagcaaaatatgtatacactgacatattaatagacatgtaagttctttggaacttttcactgtgttatgtggacattgttgt

SEQ ID NO: 258615 - DNA, 2901 bp, Homo sapiens
  misc_feature (2)..(3): n is a, c, g, or t
  misc_feature (5)..(5): n is a, c, g, or t
  misc_feature (7)..(7): n is a, c, g, or t
  misc_feature (9)..(9): n is a, c, g, or t
  misc_feature (227)..(227): n is a, c, g, or t
  misc_feature (369)..(369): n is a, c, g, or t
  misc_feature (377)..(378): n is a, c, g, or t
  misc_feature (882)..(882): n is a, c, g, or t
  misc_feature (915)..(915): n is a, c, g, or t
  misc_feature (920)..(920): n is a, c, g, or t
  misc_feature (937)..(937): n is a, c, g, or t
  misc_feature (983)..(983): n is a, c, g, or t
  misc_feature (1076)..(1076): n is a, c, g, or t
  misc_feature (1419)..(1419): n is a, c, g, or t
  misc_feature (1506)..(1506): n is a, c, g, or t
  misc_feature (2023)..(2023): n is a, c, g, or t
  misc_feature (2270)..(2270): n is a, c, g, or t
  misc_feature (2454)..(2454): n is a, c, g, or t
  misc_feature (2564)..(2564): n is a, c, g, or t
  misc_feature (2829)..(2829): n is a, c, g, or t
gnnangntntttaagtgtaacccttacttgtagggtgccaagtaaggagaattgggttgcttacgcttgacacccgacctcccagatggcttaaacgtaagggtttatggaggcagggaggcataagttataggcaaggtcataaatcaacacagggaggctatacattggtttgacttaaaaagacaggacatctccaagcagaggcccacaggtcataggtggantccaggattttctgatttgtgattgattaaggagtcaaagctttgtctaagaatgtgtgatcggcagaaaagaaggtgagctctggttcataggcatgaccttctccaggcccctcaggaagaaatttagaacaaagaatancaatcagnnttgagtcctcagcctctccttacctgagatctgtgtgccagtggctccatttggtggggtctaggtttctggaaaacaactcagggacatattttaagatgttgtctttggtttttacagggaaccaaacatcttgtgactttagtttgtttggctattaagtttttttttgttgttgtggtttattaagtttttatttacttttttaggactagttaagtgactggaagttttttgaatgcaccgaagattaaaaaaattatgtctttgggggcccacaggctcctaagaggggttcctgctctgttttaaggatccttaacttaatcatatctatgatgtttcagttcagtttcagttcagggtcttccctgaagttattagatgtcaactgggactgtaatcgtccgaaggtttgactggggctggagggtccacttcaggatggtgaactcctatgactggcaggtggtatctggctatatgcaggagggctcagttccnttccacatggcccgctccatatttttcccatanggatncttgagtgtccatatgncattgtggatggcttcccccagagtatgcagcaatcaaggcagtantagattttatgacctagccttgggaagcacacactgtcaccttcacagtattttattggtcacatgggtcagccccattcaatgggggagggnactctataagggcacaaatgccaggaggcctcagaaacataaatatttttgctatgggtatagattcatgggttttaggctggaagaaaccacaaaaataccctggttgacagtaagaatcagtcccattgatgataaaagatggaatttaaaagcttaatagggacaattttcttctgcaaagaggtagatggggtggcatgaatttcttgtgttagagacagttttaacagatgaaccctcaggtgccaagtcagttaaccagagctgggttgacaatcagggatttaggagggaaaaacccaaggcaaggaaagtccttgtgaatgtgaccaggtggagnaacaggtagatgacgatttgccaactccatgttcaggggctgagctgaggccagagtcggcagctggtatttcttctccaatgggcnacttagggtggctttttgggctcagtggcactccagaacaagtctagcatattggctggtggtagcaggaccttactgacattccatatggaatggagctggaagcagtcctgtgaggtctgggtgacactcgcacatcctgtaaggatggagaagcaatggactagggagctgagacccccaagaccatcattcttgcccaggcttcagagacaactgaacttcttcttggtcattcacaccagactggagatggctgagtggttgttccgtaagagcaaggagagagaagccggctccgggaattaagggcgtgtgcatcgggtagaatgcaagccaagcattcagaaatggtccagtccagtgaaatggaggcttgtattgagtctggggcccaaggctgagagaaggctggctccgtcgaaccagaaacagcactgagaacctggctggtggcaccggcttcagctgcacagagagggggtcagcaggccacacagggtcatcctgaccagcngtcttttttgtggggtgtcgtgaagaaaagcaatgctcaagggtagataacgaattttctaagactgagcagccagcttagtggcagagtgaaaatgagaatagaagtggaagtacactggaatgaagatggctgcttagttttatctgcctcacccactagctagaacgtggctttagccataataccaatatgtatttttggaacattcctttgctcttttcctttgactttggatagcagatgnggtctattgcattgctgtgattttcagatgaaatcaagcacagtggtttacttttaaccaaaccccagtcatacttcctctctctgactcagcttccttgtcgtacgtaagattgatgacacacgccaccagctcacatttacaaaggcgttctaggtcttttgatgaacacctatatggcatntatattaatataattttctctgtgagaggagagatttaaatgagagttgtcttagtagctgaggaaacagatacatgattaggggaatagctaatttcttgcctgatgtnatgtatggaaactgagaaaagcctggaaaaggaggttggaaaactgaaagtgggtgggcaccacttttcacacccaaccctctttccatgcccaaaacaccgtggggcatcccctcctcacagggcctgtgtgctgggctgcactgacatgcattccggctcagagttggcttcacccttaacagcgggtactgggactctgtggacacatggacaactttacttaactctaaatcggggtgtccagtgttttggcttccctggnccacattggaagaagaaaaattgtcttggaccacacataaaatacattaacactaatgatagctgatgagct

SEQ ID NO: 258616 - DNA, 261 bp, Homo sapiens
gaagggctggaggctaaggattgacttgcttagttaactagagaagcagatggggttgggaggttctgtgctatgtctctccctccacagacaaggctgaacctgggagcaaaataaggagttggggttgggtgtggttgctcacacctataatcccagtgcttcaggaggctgaggcaggaggattgcttgaggccaagagttcaagaccagcctaggcaacctgggagagtctgtctctacaaaaaaatttttttaatt

SEQ ID NO: 258617 - DNA, 472 bp, Homo sapiens
ggcctttttattaccacttttcacctgtgaactggctctgttctaccttgcgttgcctatgcaaataaggataaacaaactccattctctcttccaagggggagagaattagcagcaagagggcacatatttctctttgttaaaacctgggaatggcatcactcctttctttccctagtgactaatcttgtaaagtgttaaagagaagtctaagtcccccagagggacttagaaagccctggccattcatgcccaggtggagccactttagtaaaaaaaatagcatttttgctgccatgtgatgcacaggtaaaacagaccactggatactgctggtttgcattcctgcttcctgggaagttctcccttccatttcatgagcctctttgggaaaggtacaaacttagggaattactgacacagaataggaacaattggcaatcctttcactctttcacatatactgatcttt

SEQ ID NO: 258618 - DNA, 408 bp, Homo sapiens
aaagcagataaggaactatatattcaaatatctccagggactaggcaactaacaaaaatgagtaagtggtttgagagaggactggagtgaactggagaccacaggccttactatcagggggcagccttattcagctccagcagattgtgctagaagaaagtgaaaactactgcaagggcaggcatatgcctttaatgcctttagtcacagctactcaggaagctgaaacaagaagattgtttgagcccaggagtttgaggcaagcctggggcactccatcacttaacaacaacaacaacagcaaaaaaccctagtgccgccagaactttgcaaaagaagcttgaaatcctaaatgtgtacgatttcccaatgtctaaatgttagcaaccaattcaattactcaaaact

SEQ ID NO: 258619 - DNA, 695 bp, Homo sapiens
ctgggtcttggacttccagctcccaaaactgtaagaaatacatgtctgccatcaataagccacccagtctaaggtattttgttatagcagcccaaatggactaagagaagctttctgaaggccaaatatcctttaatgcagagactatgaaataaacaagaaaacagtggtcgagaaagctaagagcctcctcggctagaagccatggtctagccaccaatctgccacctggatgaaacctaaacagactgtggacgtctcccactgtcccttcttaatctctggttgatgcactgggcaataacgctacagaaagccatttgctaattgctgcaataaggtaaaatgttgcattaaagggaaaaactgggtgattcatctagttagtgattagcagcctgagatttctcagatattactctctctatttcagcaggttaatagataggaaaattagcagataatttaaataatggctcatttaacacaacgattcctaattatattagcagcccatctgctgaagtctgccggcaagccgaacccacagcagcagtggcctctgcagcccagccacgcggggctgtttgcccacagttattacatatgattgtaggcactgattctgttaatcaggctctttcagcgcttcagttctagaaatgaatctcatttacttaaacacatcttgttga

SEQ ID NO: 258620 - DNA, 679 bp, Homo sapiens
tggtattctatgttgaaaggaaaattttactatacttaagtgctgttccaaggttaaatactcatacatatatttaatgttccaattctagaaatcaaacttaagaagtaacacttttggtggaaccacaaacggaaaagagtcttgggtcctgaatcatggtttggagaagacctttatgcctattaggagccaaaagcctaaaactctaaacttaaaacacaagcaatagaatgttgattctgtcctgtctgcagtatacaggattagctttttctgttaagataaaactaggaaataaagttgtgtgtggaagcaataaaaatctgaactattcctacatgtaattctagaaatttataggtgctacattttttgaaaattttaatgacatatataagaaggaaaatcaaattaaaaattcaagttgatgttatctttaaaaaaaagtaatagttcatcctgttcattcataatctaaattaggtaaaaaccagtgataaaatattgtgtgttattttaaaatatatgtatatctacacaaacgatattatatatacaaatactcgtactcatgtacacaccctatcattaataaagcatcattgtttaattttaggaaaaaaataactacaattgggaataaaattgattgccctattacatccaaaagtcacca

SEQ ID NO: 258621 - DNA, 1775 bp, Homo sapiens
aaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtgggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaataa

SEQ ID NO: 258622 - DNA, 1650 bp, Homo sapiens
tcctgctctggggaagtgggcacacgttaaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaataa

SEQ ID NO: 258623 - DNA, 1531 bp, Homo sapiens
aggaagctgcttcggggggtgagcaaactttttaaaatgcagaaattatgatctacacccgtttcttaaaaggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaataa

SEQ ID NO: 258624 - DNA, 255 bp, Homo sapiens
  misc_feature (10)..(10): n is a, c, g, or t
ctcccggggntgggcagggacgtttctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctaataa

SEQ ID NO: 258625 - DNA, 533 bp, Homo sapiens
agattatgatctcttaattgccaaatccagtcaactctttccagtcctcatgttaattggcctctctctttcagcagcatttggcacaggtggccacagcttttccttcctttctttcctcctctggctcctaatcacatatgtttatgctatttctgctgtcaccatttcttctcaatttccttagctgactctactttttctgcctccctcttaaatcttggtgctcctcagagttctatcctaggaattttattctcattctgtaatacatactgtacgtggattaccttatccattcccatggcttctactatcatgagtatactggtgacttcctaatctatacctcaaattgtatttggaaagatagattaggttcagtgagatgagacaatagctgggatcataggtgtgtgacattgcacgtgtcaggtgcaatgatcccagctattagggaggctgaagtgagaggacagcttgagttcaggagttcaagaccagcttgggcaacatagtaagacctgtcttaa

SEQ ID NO: 258626 - DNA, 258 bp, Homo sapiens
agattatgatctcttaattgccaaatccagtcaactctttccagtcctcatgttaattggcctctctctttcagcagcatttggcacaggtggccacagcttttccttcctttctttcctcctctggctcctaatcacatatgtttatgctatttctgctgtcaccatttcttctcaatttccttagctgaagtgagaggacagcttgagttcaggagttcaagaccagcttgggcaacatagtaagacctgtcttaa

SEQ ID NO: 258627 - DNA, 1584 bp, Homo sapiens
ggggagaggaagagtggtagggggagggagagagagaggaagagtttccaaacttgtctccagtgacaggagacatttacgttccacaagataaaactgccacttagagcccagggaagctaaaccttcctggcttggcctaggagctcgagcggagtcatgggctctctggtcctgacactgtgcgctcttttctgcctggcagcttacttggtttctggcagccccatcatgaacctagagcagtctcctctggaagaagatatgtccctctttggtgatgttttctcagagcaagacggtgtcgactttaacacactgctccagagcatgaaggatgagtttcttaagacactaaacctctctgacatccccacgcaggattcagccaaggtggacccaccagagtacatgttggaactctacaacaaatttgcaacagatcggacctccatgccctctgccaacatcattaggagtttcaagaatgaagatctgttttcccagccggtcagttttaatgggctccgaaaataccccctcctcttcaatgtgtccattcctcaccatgaagaggtcatcatggctgaacttaggctatacacactggtgcaaagggatcgtatgatatacgatggagtagaccggaaaattaccatttttgaagtgctggagagcaaaggggataatgagggagaaagaaacatgctggtcttggtgtctggggagatatatggaaccaacagtgagtgggagacttttgatgtcacagatgccatcagacgttggcaaaagtcaggctcatccacccaccagctggaggtccacattgagagcaaacacgatgaagctgaggatgccagcagtggacggctagaaatagataccagtgcccagaataagcataaccctttgctcatcgtgttttctgatgaccaaagcagtgacaaggagaggaaggaggaactgaatgaaatgatttcccatgagcaacttccagagctggacaacttgggcctggatagcttttccagtggacctggggaagaggctttgttgcagatgagatcaaacatcatctatgactccactgcccgaatcagaaggaacgccaaaggaaactactgtaagaggaccccgctctacatcgacttcaaggagattgggtgggactcctggatcatcgctccgcctggatacgaagcctatgaatgccgtggtgtttgtaactaccccctggcagagcatctcacacccacaaagcatgcaattatccaggccttggtccacctcaagaattcccagaaagcttccaaagcctgctgtgtgcccacaaagctagagcccatctccatcctctatttagacaaaggcgtcgtcacctacaagtttaaatacgaaggcatggccgtctccgaatgtggctgtagatagaagaagagtcctatggcttatttaataactgtaaatgtgtatatttggtgttcctatttaatgagattatttaataagggtgtacagtaatagaggcttgctgccttcaggaaatggacaggtcagtttgttgtaggaaatgcatatttt

SEQ ID NO: 258628 - DNA, 303 bp, Homo sapiens
ataactagtagcagactgtttttagtttctttctctatagtagatactttttctcctataaagaagggaagaatatcaaattttcccaaatatctatagggaatttagtaatgcaccatgcagcaaggaaggagggctcatgttaaagtgtaaatgggccttctgagtacacagaaatcaaccagtgttactttcagaatgtggctcttgctaagccctggatatgagatcacaaaaggctcaggtgagctgattcccattagaccaggtaggagctgattattgtgtggtgcaatgatatgc

SEQ ID NO: 258629 - DNA, 247 bp, Homo sapiens
gaaatggactggatgactactagcgtgattttcaggacaatggctggcatgaaggccttaagcaaaacaacaaaatgtgcataatgttttcttttcccactttgtgacttttagcatttctacactttcacaccctttccaatccaagatattttacttactctgtttccttaagtctaggacagcactgcttgtaaaatgcaattctatgttaaaacaaataattgggatttctgattttagaaat

SEQ ID NO: 258630 - DNA, 2221 bp, Homo sapiens
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccgactctaccggctaagccgcgtctccagcgaggtggaagctctgcctccctccacaacagtctcatgaggaatagcatcttccaactcatgatacacacccttgacccactcgccgaagaacttggatcatatggaaaactaaaatattatgacacaatgactgaagaagggaggttcagagaaaaggcttcaattctccacaagatcgccaagaagaaatgtcatgtggatgagaacgagcggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 258631 - DNA, 2170 bp, Homo sapiens
tgaaagaaccatctggttgagtctaaagttggaagatcaccatatccaccagaagacccaggatggatctgcaacaaagcaccaccatcacttccctagagaaatggtgtttggatgagtcactgtctggctgcagaagacattatagtgtcaagaaaaaactgaagttaattcgagtcttaggccttttcatgggtctggtagccattagcactgtctcattttcaatcagtgccttttctgagacagatacacagagcacaggagaggccagtgttgtaagtggccctagggtagcacagggttaccatcagagaactctcttagatttaaatgacaagattctggattatactccacagccacctctttctaaggaaggcgagtctgagaatagtacagatcacgcccaaggagactacccgaaagacatcttttcccttgaggagagaagaaaaggtgcgatcattctgcatgtcattggaatgatctacatgttcatagccttagccattgtctgtgatgagttctttgttccttctttgactgtcatcactgaaaaactgggcatctctgatgatgtggctggagccaccttcatggctgcaggagggtcagccccagaacttttcacatctctcataggggtatttatcgctcacagcaacgttggcataggcacaattgtaggttcagcagtattcaacatcctctttgttattggcatgtgtgctctgttttctagagaaatcttaaacctgacatggtggccgctctttcgagatgtgtctttctacattgttgacttgatcatgctgatcatatttttcctggataatgtcatcatgtggtgggaaagcttgcttctcttaacagcttatttttgctatgtggttttcatgaaattcaacgtccaagtagaaaaatgggtgaagcaaatgataaaccgcaataaggtcgtcaaggtgacagcaccagaagcccaagcaaagccatctgcagccagggacaaggatgaaccgactctaccggctaagccgcgtctccagcgaggtggaagctctgcctccctccacaacagtctcatgaggaatagcatcttccaactcatgatacacacccttgacccactcgccgaagggaggttcagagaaaaggcttcaattctccacaagatcgccaagaagaaatgtcatgtggatgagaacgagcggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 258632 - DNA, 1110 bp, Homo sapiens
tctttgtgtcttttactgtgatgttgtagaacttggatcatatggaaaactaaaatattatgacacaatgactgaagaagggaggttcagagaaaaggcttcaattctccacaagatcgccaagaagaaatgtcatgtggatgagaacgagcggcagaatggggctgccaaccacgtggaaaaaattgagcttccaaacagcaccagcacagatgttgaaatgacaccatccagtgatgcttcagaacctgtacaaaatggaaatctctcccacaacattgaaggtgcagaagcccagaccgctgatgaggaggaggaccagcctctcagccttgcctggccttctgaaacccgcaagcaagtcacgtttctgattgttttccccatagtgtttcctctctggattacgttacctgacgttcgcaaaccttcatcgaggaagttttttcccatcacgttctttggctccattacctggattgcagtattctcttacttgatggtctggtgggcgcaccaggttggagagacaattggcatcagtgaagagattatgggcctgaccatcttggctgctgggacctccatccctgatcttatcaccagtgtcatagtggcccggaaggggttaggggacatggctgtgtccagctctgttggaagcaacatttttgacatcactgtagggctcccactgccctggctcctgtacaccgtcattcacagattccagccagtggctgtcagcagcaatggccttttctgtgccatcgtccttctcttcatcatgctgctcttcgtcatcctctctatcgccctctgcaagtggcgaatgaacaaaatcctgggcttcatcatgtttggcctctactttgtgttcctggtggtgagcgttctcctagaagacagaattcttacatgccccgtctccatctagcaggaaaagccatatcttgcaccagcagcatgaatggtccctccacactctgggctctgggctccttgacctcttgagaagaggcagctggcacacagccctgggtgccaagtgtccctccttggtgaatttgaggagagatggattcacactgggcccattcacttcacagg

SEQ ID NO: 258633 - DNA, 637 bp, Homo sapiens
ggtgaaacccgtctctactaaaagtacaaaatattagccgggcatggtggcaggcacgtggaatcctagctacttgggagactgaggcaggagaatcgcttgaacccggaagatggaggttgcagtgagacaagatcaccccattgcactccagcctgggtgacgagtgaaactccgtctcaggaaacaagttaaaagtaaaggaatggcaaaagattcatcagaacaaagtggctatattaatatctgacaaagtagactgcagagcaaagaatatttctaggattaaagaacatttcatcataataaaggggtaaattcatatagtgaacataaaaattacatttatacaaccaatgacagagctttaaaatatgtgaaacttgatagtactgcaggaggaatagataaatccttaattatagttggagagttcagtacaacttctcacattacttgaaagaacaagtagagagaaaatctacaaagatatagaaaacttcattattgttaactaacatgacctaattgatatttatagaaaacgccactcaatatcaaaagaatgtatatgtttttccaactgcactcgaaacattaactgaaaaggattctaagccataagacagatctcaat

SEQ ID NO: 258634 - DNA, 434 bp, Homo sapiens
gccgcaagttgttcaccatgtggatcctctcatcgtcctccgagatgagaaaagcaaagctcaagagaggatgagtgatgggctcgaagatgcacagtgagtgactgaacaaagatgaaaacccagggctgctgggtccctcgttcaatattgtccaaaatcactggaaagggaggaagcggattttaaatttgactctcatttgtgtgtgtatgcaagtcctctctaaaaggacttaggagaagctagggagagtgtttacctacagggaggagactggacaccggaaggttgtggaaggttgtggaagggtgtggtatggcgtgggaaggacactctttactggtactcctttgtatctcttgaatgaattaaggcatgtattacctctttaacaaccaaataaaagttgatccagttctttccttcctgca

SEQ ID NO: 258635 - DNA, 687 bp, Homo sapiens
ggttagtatcagaatgagtgacacagataaggtatactgtgggaactcagagacagaggagataaatatatccttcacctatgtaaagccaccaaaaaatctgagaatcgagctaagatttgttaaatttgtaccaaataattttcttaaattaaacaactttggatacaaaatcaacataaataatcagttgcatttctatatgccaacaacaaataatctgaagaagaaatccagaaagtaatcccatttacaatagctacaaataaaataatatactaggaataagctcaaccaaagaagtgaaagatctctgtgatgacaactacaaaacatggatgcaagttatttaagagaacagaaaaaaatggaaagctatttcatgttcatggattggaagaattgatattgttaaaacatctatactacccaaagcaatctacagattcaatataatctctaaatctctatcaaaataccaattacattattcgtggaaatagaagaaaaatgctaaaacttatgtggaaccacaaaaaattcagaagagccaaatccaatctaagcagaaagaacaaaatttgaggaatcacattatctgacttcaaattatactactgagctatagtaaacacagcatggtactcacatcagacacatagacccatggaacagaatggagagccc

SEQ ID NO: 258636 - DNA, 417 bp, Homo sapiens
tgttttgtagtttttagcagttggatcttgcttgtattttgaaatcttacacatttatttcatgtttgtggtactgttgtgaatgatacttctcaatttccagttggtgattgctagtatataggaaggtgattttatgttatatgctgaccttggattctacaaccttgctaaactcatttttagtactagaagcttttttgtagatttttggaattttgtgcatagacagtaatgtcactggcaaataagggcagtttaatttctttgttttcactttgtatacttttatttccttttttttttttgagacggagtttctctcttgttgcccaggctggagtgcaatgcagtgagccaaaatcgcgcccctgcactccagcctgggcgacagagtgagactctgtctccccccca

SEQ ID NO: 258637 - DNA, 949 bp, Homo sapiens
ctgtgactgtgagctgttctgttcttttgcctattaaactcctgctccaaactcactcgatgtgtgtgtgcatgtccttgacctcaatatctggtcgtgtgaccaagaacctcagtattcaccccagacaacaaggctgcttcattttgagggctcgtctgggatttgaaggtgacttcatcagaatgctttgctgctaaagggatctgcagtccagctgaaaacctgcccttgcctgagcccagccactttctcccagagaaaactggagaacctaaacatgattgtgaacagaatggcttccggtggcctgggactccttggggaaacagaaaatgcaccacaaatcccattttaggaaaaatctgttttcctcggagcccctggaattaaagaaaccatcaagcttcagatggtgctgaaaatggagccgaaaatgaaactgccctcctacgagggacccttaaatcaaccccaggaggagccctagctgctgttccccacacaacgccactctccagcaggaagtagccagaagaaatcgtcacccagtttcccctagcagcagcgcagtaagattgaggagctaaaaacagacttgggtggatgtctgcagctgcaagaagatgtgtgggaacagacacagaaactctccctcccagataagcaagacaaagaaacacagaataagagtccatctatgtggtcagagaatgggataagagctgatttaaaaaaactctgctctatatagaaggcacacctggtcccaaccaaaccactggaccctaggaggataagacctcctctgctcatgagccccctcctcagtagcccatttataaaaaccctgacaattttactaccacttggcaacccgctcgggacccctctctgtgatggagagctgttcttttcttttgcctattaaactcctgctccaaactca

SEQ ID NO: 258638 - DNA, 720 bp, Homo sapiens
tcttaatactcatatttagaacctatattctaaacctccttgtgaagtttatctcttctcgcttagaaaccatcaagcttcagatggtgctgaaaatggagccgaaaatgaaactgccctcctacgagggacccttaaatcaaccccaggaggagccctagctgctgttccccacacaacgccactctccagcaggaagtagccagaagaaatcgtcacccagtttcccctagcagcagttatggatttcattcctgaggggggaaatatgttataggaggcagaaagaaatgatttaggtagacatttagggtaaagtgagtccccagcagaaaactttccttttaacaaaaagcactaaaaacagacttgggtggatgtctgcagctgcaagaagatgtgtgggaacagacacagaaactctccctcccagataagcaagacaaagaaacacagaataagagtccatctatgtggtcagagaatgggataagagctgatttaaaaaaactctgctctatatagaaggcacacctggtcccaaccaaaccactggaccctaggaggataagacctcctctgctcatgagccccctcctcagtagcccatttataaaaaccctgacaattttactaccacttggcaacccgctcgggacccctctctgtgatggagagctgttcttttcttttgcctattaaactcctgctccaaactca

SEQ ID NO: 258639 - DNA, 483 bp, Homo sapiens
aaaaggttcaggggtgtgggcatgttgaaatttatatactccgtgcatctagaagacatttgagacgatcatattccacatgaaggtgtaaataacacgtcatttataaagatcattagacataggatgatgaaaggggcactgatgtcactaaaatattcagtgatggctcatctctgtaggcaagaatgacaatagaaaggctgttccagaacttggctgggtgatagcactggggatgataggatcctaagacaaaagaggccattctgggacatagtggggaccaaagaaaaaaacccaagaagccaaaggcaacacttagctggcagaagtcagaggattgcaattatagcagccagcagggtctgagtggcagccaaggggacctcacttgtatggttatagaactggtcaataaacatggcatccctggaggcaaaacaggtgggcagctaagaagggtactactcagctggcaaa

SEQ ID NO: 258640 - DNA, 430 bp, Homo sapiens
  misc_feature (60)..(60): n is a, c, g, or t
aaggggggccaacttgaattgttccacttaaaaattattcccagggatggctcatctgcnccgaatgtctgacagctgatactggagattggctgtcagacattcggagctgatggctcatctctgtaggcaagaatgacaatagaaaggctgttccagaacttggctgggtgatagcactggggatgataggatcctaagacaaaagaggccattctgggacatagtggggaccaaagaaaaaaacccaagaagccaaaggcaacacttagctggcagaagtcagaggattgcaattatagcagccagcagggtctgagtggcagccaaggggacctcacttgtatggttatagaactggtcaataaacatggcatccctggaggcaaaacaggtgggcagctaagaagggtactactcagctggcaaa

SEQ ID NO: 258641 - DNA, 639 bp, Homo sapiens
gacaacagaaggtctagaatagtccataaacttagctgagaaagcagcagcaggagttgagaggattgacttcagttttgaaagaagttttactgtggataaaatgctatcaaataacctcacatgcttcagataaatcttttgtgaaagaaagattcaatagatgcataaacttcattttttttaattttaagaaattgctttagccaccccaaccttcagcaatcactaccctgatcaatcagcagccatcaacatcaaggctaaaccctccattggcaaaaagattatgatcgctgaaggctcagatgattattagagtttttaatttaattttttattagcaataaaatatttttaaatttaaggaatgtacatttttttaaagacatagtgctatttcatacttagtactctacagtaatgtaaacacaacttttcaatgtactggaaaacaaaacaaacaaagtctcattttattgtgatatttgctttattgtggtggtcttgaaaaaaacccataatatttttgcgatattatgcctatatgaatagaattaaaagcaaaatatatatacttaatgtattataaaaaagaaaaaagataaaacaaattattgaataaatatatctacatgc

SEQ ID NO: 258642 - DNA, 7021 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttg

SEQ ID NO: 258643 - DNA, 6828 bp, Homo sapiens
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacat

SEQ ID NO: 258644 - DNA, 442 bp, Homo sapiens
gttaactgaaggatgtacgcggtcttagagacatgtatgtctctattcttttaaatctgaaagcattatctaaaacccaatcatcatatacctgtagggaaaaagcctaacacagccatatccaaaagtcatagtccgtcagaagtatgttaaatgttataaaattacttgacctcagcatttctgagttttggtgttttcaatttataatataataggtgtttggtttattttaaccaaacttaaaaagcaatgatgtctgcaaagcctctgattggaccaaaagtcaccatttatactctgacattgaggccaggcacggtaactcacacctgtaatcccaacaatttgggagaccaaggtgagaggatcactttagcccaggagttcgagaccagcctgggcaacacagcaacaccccatctctacaaagaataattgt

SEQ ID NO: 258645 - DNA, 737 bp, Homo sapiens
cccagtacactcacctactacaggctgcatgatcttattacttcactgaactgtttccttatctgtaaattgtttgattatctacaaatgtgtagcttgctacctgacagcattagatattggataattggttgtcattgctattaataaacacggacttagagagttcttgaagttttagttttatgctgagaatccatgtaacactggcaatctgtgtctatacctgtatctatagcaaaagccagaatttaccacaaattttgctgttgtatcaggaaatacatcttgacaactgatacttattcttaatattattattctgttatttcttattctaggccccaaaaacttttattaaaatgcttcaaattttaggttagcatttttgttgatgtttggacatcttaaattcattatactcatgcaaaatttttttttttttttttttttggagacagggtctctgtcacctgggctggaaaatatatctttatagttttatgcacatttggcaatcagcagaaataataaattgttgtactatgtctatgctttgctatctttatgtgaccaagacattactgtgaaactgaatactatctggccacatatataaccattgctattaagaaagttatgattgtgacttggaaatagtcatatggagacagttctgatttaattcccaggtaactttcatattcccaccattttgccgtgtgcatttcaaaata

SEQ ID NO: 258646 - DNA, 415 bp, Homo sapiens
agccttagcaaagagataaaaacagaatatgacacgagtgataatagagtggtacagtagaggagatgacgtctggatatttgaaaagcagtaagtatgtaggtgtaagtaaacattactaatgatacgatgcaatggaaagaacactagcacaggagctcattctgtcctcgaggcttaccatgtgtgatccaaagtaatactctgttcctgtgtttctttatctgtaaaatgggtataacaccacattgcttatgtcctaaggtagagaagcaaataagagctgtgtatgtggaagcactttgaaaactttacactgctatacaaatgtctaacattattactattgtatcgccaaaaatagtggagaatcaacataacaaaatgggtgattcagaactaaacttatttcacc

SEQ ID NO: 258647 - DNA, 686 bp, Homo sapiens
taactactcaggaggctgaggtgggaggatcacttgagcccaggaggttgaggctgcagtgagctgtgattgcgccacagcattccagctctaacctgggcaacagagcaagatcctgtctctaaataaataaataaataaataaataaacagaataaggtagatttatatgttctgacatggaaagatcttgaagatatagttaaatgcaaaaacaagtggaccaatagagtatgatatcatttatgttttttttaagtttaaaaaactgctatggggtagcatgtgtgtgcacatacatgtgtatctgtgcttacagacacatagaaaatggtctgaaagaacatacattaagaatctactgagcttgcatgtgttgggggtgggacccgtggcttccccctgtgcctccaggccaccgaggtctgcatctgccctgtggagttcaacccccacttcgtggcacctatgatacccaaggtggagtgggcggtgttcctggaggtggctgataacttgcacctgacccaggtgctaaagggccggttgagggatatgaggagaacgaagagtttctgaggaccatgcacctcctgctgctggaggtggaagtgatggggggcaccttgcagtgcccagagtctggatgtatgttctcaatcagccacaggatccccaacatgctg

SEQ ID NO: 258648 - DNA, 657 bp, Homo sapiens
ctgcataaagcagttgcctgccacacccaaagaaaatgataagaaatgtgcctcttttgcatgctgtgattcatttccactttgaataagagggaatagaaaggagattctaggagaaggctttggcttagaatcaggggtagagagtcattctataagttaataaatataaagaattcagtatgatgccagacacaaagtactcagtaattactagctattatttttattactatttatattttattgataatgtcagcagcagtgcagggaacctggcatctatttctagtattgtgtgtcaaggttgctgtaaatctagagaatggcagcatctatgctctcttttcattgcaatgcccccagtacagctaattttttattgtctcacctggatcagatcacagctgctagcatggcctccacttgcaagggcttccagtttaccatccagttcattctctttaaatgttgcaactatcttccttaaggacatctttggttatttaacacttccttctgcgatggtttctaagggctcaccaaataacagtgaatgcccttaccataacatttgaggtcctctaaagtctagcctcaaactactattagcctttagtttccatcatagggctaaagagtggatataaagatgca

SEQ ID NO: 258649 - DNA, 1649 bp, Homo sapiens
tccttttctttttaaaaaaaaaacactgcaactggaacagtttctgatctcaaaaggcaagcctcttcccgtgtgatctttataatttacactcttttccgtgagctttcttacctccctttttttataactctccatattctctattcatacatatatccattatattagtagtggaataatttttatttttatttattttttttggctttagtacttgcaccctcacacacactctcccgagaaccagaagtcggttgggtgtttatataatgaagaattatggggctgtttgatcgaggtgttcaaatgcttttaaccaccgttggtgctttcgctgccttcagcctgatgaccatagctgtgggaaccgactattggctctactccagaggggtttgcaagaccaaaagtgtcagtgagaatgaaaccagcaaaaagaacgaggaagttatgacccattccggattatggagaacctgctgcctagaagggaatttcaaaggtctgtgcaagcaaattgatcacttcccagaggatgcagattacgaagctgacacagcagaatatttcctccgggccgtgagggcctccagcattttcccaatcctgagtgtgattctgcttttcatgggtggcctctgcatcgcagccagcgagttctacaaaactcgacacaacatcatcctgagtgccggcatcttcttcgtgtctgcaggtctgagtaacatcattggcatcatagtgtacatatctgccaatgccggagacccctccaagagcgactccaaaaagaatagttactcatacggctggtccttctacttcggggccctgtccttcatcatcgccgagatggtcggggtgctggcggtgcacatgtttatcgaccggcacaaacagctgcgggccacggcccgcgccacggactacctccaggcctctgccatcacccgcatccccagctaccgctaccgctaccagcgccgcagccgctccagctcgcgctccacggagccctcacactccagggacgcctcccccgtgggcatcaagggcttcaacaccctgccgtccacggagatctccatgtacacgctcagcagggaccccctgaaggccgccaccacgcccaccgccacctacaactccgacagggataacagcttcctccaggttcacaactgtatccagaaggagaacaaggactctctccactccaacacagccaaccgccggaccacccccgtataaagaccgcgggcctcgccagaagaccgcgggaggagggcgcggtccccgggggcggggcggggcggggagacccagaccctccgctgggagaccttccaaaagcaaaaacaaaaaacaaaaaaaacaaaaaaacaaaaaacaaaaaaacacacacacacaaaaaaagagaaaaaacataacaagtaaattttaaaaaaaagaacaaaatataagaggaacaaagaagcaaaacaacaggaaatgtgggaaaatataaacgagggaagaaaacaaactttaaaaaaaagcgagagggataaaaaattaaaaatagaaaataaatctaaaagaaaatgcatgatttcccatgtaccattattttaacatttaataaaaatcaatttaaatgaaaaaat

SEQ ID NO: 258650 - DNA, 403 bp, Homo sapiens
tcatgaaggcgcgggaccggggaaggcccacacagctgtccccgtcctttacggctgccctgtggccgacttcctgagaaactaacgtccttctctctgatcccccaccccgccaccctgcgccccgcaggtctgagtaacatcattggcatcatagtgtacatatctgccaatgccggagacccctccaagagcgactccaaaaagaatagttactcatacggctggtccttctacttcggggccctgtccttcatcatcgccgagatggtcggggtgctggcggtgcacatgtttatcgaccggcacaaacagctgcgggccacggcccgcgccacggactacctccaggcctctgccatcacccgcatccccagctaccgctaccgctaccagcgccgca

SEQ ID NO: 258651 - DNA, 244 bp, Homo sapiens
agacaagacacgatgacctgcagcatggttggcattttcaaccccaagaattgagagaacccaagaacggagtggaagtaaaagcaagtagaatgaaggtagcagctgagactgaaattatccctccctaccccgctttcatgtaccctggcagtgggaccactgctccatgataatgatattgaagagtgaaaaggacatgaacttttaaatgaagagtaatgagatagaaagacataagaat

SEQ ID NO: 258652 - DNA, 470 bp, Homo sapiens
gcacttaatattgtaattggttttccagcgctttctctaagtttctgctcgattgagttaaaagcgctgctgtccttaatttgcttaaggcttcaaacacgatctaaaagaagtggtgcacagagctctcgtcatgtgagaacaattcaatgtgatgtcttgccaggaatgataaactctggtgacttgataaatctcagagttcagatttcagatgaagttagctttcagcctggcattcccgtccaagcacatgtaaggctccgcaaaattgatgacaccataaaggagtccagtttccaccaccacgatgctccgtcctcaaagagagcacatcccagtcgcctctctctggagggctttgaatgcctctctgatcagtcaacaggacccttgaatgagcacttattcattgtgccagtaatcttttcagaggacagcagtggcagcaggtagtacatacttactag

SEQ ID NO: 258653 - DNA, 506 bp, Homo sapiens
cttctgtaggttgccttttcactctgttgactgtttttttttgatgcatggaagtttttctgtttgatgtagtcctgtttttctgttttttcttttgttgcatgtactttgggtgtcatattcaagaaattattgccaaattcaaatgtcctgattctttccccctaggttttcttctaggagttttatagtttttggtcttaccttcaggtctttaatccattttgagttaatttttgtatatggtataaggtagaggtccagctttattcttttgcttgtggatatctggttttcccaacacctctcacaacattttgaagagagtggtgtttcccctttgtgcagctttggcgtccttgttgaaaatcatttggccgtctacgcaagagtttatttctgggctccctattctgttccattattatatatatctatgtcagtacctactgttttgattgctgttgcttgcagtgtgttttgaaataaaaaagtgtgaagcttcc

SEQ ID NO: 258654 - DNA, 292 bp, Homo sapiens
gctagaacaggtatttagaacaggaactggcatttagaaaacacccccaaaatgctagttgttgttactaccagtggcccttgaagccaccacacacctgtcctaccttttcatctcgacatatacacagcctgacctgtttcagcctctcacctcacagcttttccctcccactggggtaacctttgagaacaaggaccttgtcttactcccctctgtaagttttcccagccccttgtgtagtaatttgaggttattgctgaatgtatcaaataaaatgttctccatcaga

SEQ ID NO: 258655 - DNA, 891 bp, Homo sapiens
atgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggaggtaaagcccgtcaccctaagtatggataggctgggcctgggcactgccccactgagccggggagagtggggatgggggagaagggacattccacaaccattttggaccccggaccacccactctacttcccttcctcatcccagaatgtgtcactgtcttacctttctgggtctcctccggccaggatgtccccaggaccctgctcctgtccccacgtccacttcccaccccactcgagctgtgtcctgtgcagaccccagccaagggagatgaggcaggccccagcagcgagcccatcctctgctgtcttctccctgtag

SEQ ID NO: 258656 - DNA, 274 bp, Homo sapiens
  misc_feature (1)..(3): n is a, c, g, or t
  misc_feature (5)..(5): n is a, c, g, or t
  misc_feature (7)..(8): n is a, c, g, or t
  misc_feature (14)..(14): n is a, c, g, or t
  misc_feature (19)..(19): n is a, c, g, or t
  misc_feature (22)..(22): n is a, c, g, or t
  misc_feature (133)..(133): n is a, c, g, or t
  misc_feature (145)..(145): n is a, c, g, or t
  misc_feature (148)..(148): n is a, c, g, or t
  misc_feature (185)..(185): n is a, c, g, or t
nnncnannctcggngaatncgntcacatggaaaatctctcttcttctctttctctcgcacacatacacacacatgcaaacacacagagagagaaagagcctgttgtagagtaagacgctgggcaggccaaggntcaggtcctgantgncactgaccagctgtgtgagcccgtgcatgtcactttncctctctgcaactcagtttctcatctgtgcaggggtcaagcaaaaccaactccctctttggattcctggacttcagaaacggtctggga

SEQ ID NO: 258657 - DNA, 231 bp, Homo sapiens
cccttttattcttttaggcagttcctcaaatctctaccctggcttggtacaccacactagtgcccctgcttgtggtgctgggcgtcactgcaatcaaagacctggtggacgatgtggctcgccataaaatggataaggaaatcaacaataggacgtgtgaagtcattaaggatggcaggttcaaagttgctaagtggaaagaaattcaagttggagacgtcattcgtctga

SEQ ID NO: 258658 - DNA, 494 bp, Homo sapiens
cagcttttcctttcctaactcccctttcagaattgctcttgactcatgttacaacaagcaaggcagacttctcgcccctcccagatcttctcattgtacacttctccaggatggaaaattcccttgcatcatgatagcagaggattagctagaagtattggtattggtattggtattgaaaaagtgaatgacctaaactcaaggtaaaaaatccttttgcaactcatatggtttctaattcttcggtttcaacagacttaagggagatgtaattgagttaacagctgatagttttcacacatcaaatatttttaataagctatgtgattttgaaggatttagtaacattgccataacaaaacatccttctcatctacttagtgaacagtttcagttctttcataaacagagaaaataaaaaatagaaaaaaaatgtatgtgaaaccttatactagcaatgagtaacattcattcagaggcctataaactatttt

SEQ ID NO: 258659 - DNA, 404 bp, Homo sapiens
agtctcagttccatagagcattttgctagactcagctgggaacagtgcacacaaggtctgattttaatttgtgtagaatttccatgaataacaaagtctaattaagacatccattaaaagtccttaacgttaattcagtgtggaaaatcttagagttccattggattttttttttaactgatgtcttaattaggcactgttaggggaaaaattatgcaaattaaaatcaggcccttagtgttacacatttctttaattattcagtgcttgttttacgtatatttcaatttctttataagttaagagggcatattaggtgataatctgcctatattgttctcagtttttcttcactttttcaagatacatatcaccttctaaggaagcatattactctcatctca

SEQ ID NO: 258660 - DNA, 384 bp, Homo sapiens
gactcagctagttttttgtgttttttagtaaagacggggtttcaccatgttggccaggctggtctcgaattgctaacctcgggtgatccaccctccttggcctcccaaagtgctgggattacaggcctgagccgctgtgcccggcccccgtttttgtgtgtgtgtgtgtgtgtagggcttggggaggggacttttatccaaatatctctgaaggagatgctggtcacagcctccacctctggggagcgaaccaggggtctgggaatcggtgggggacatacttgcacatttctctatgtaccttttgtaaaaattgcatttttaaaaaccatgcacatgtgtcacttattacaaattaaaaattaaaaattgtttttaaaaatg

SEQ ID NO: 258661 - DNA, 384 bp, Homo sapiens
gctctcaaggtcctcccaggggtcatggagccatttggatccctaatatctcccgatccccttagcctatctttggagcagtcaggaactatctgcctcctcttccctttcatctgtgtccacgtgtcccagctgtctcctgagaaatcactcctttcctccagcccagtcagcatgtctgccttcatcatgctgtaattttccaaagctccagtgtttcaaaccggtgtttcaaggcagttcacttgaggccaggagtccaaggctgcagtgagctatgactgtgccctagcaagcccagcctgggcaacagagtgagaccctgtctcaaataaaataaaatataaaataaaataataaaataaaatactactgttttccatg

SEQ ID NO: 258662 - DNA, 368 bp, Homo sapiens
acagggactcctggactcttactttctaaccagcctggcgcccatggggtggggttgggcattctgggaaaggctgggcctggaggctttggaggggagggcctgagtgaccccttgatgacttttgtctccctttcccgttattctccctacctgcccccccccacctgccccccaccccatgtctctatgggcacctacttggcccctcatcccccctcttccggccctctcctctctacccctcgcttcccttcctgtctctccagcctggtgacagagcagaactctatctcaaaaagagagagagagagagggagagagagagagaggaagaaaggaaaggaaagaaaaaagggagagaggga

SEQ ID NO: 258663 - DNA, 612 bp, Homo sapiens
tttttatcttgtcaaaaataactcttcttcctcagtccatgtaagccatctaaaacttttctactcattccacagttgcctgaaaatgtgaagatcagaaatggactgaggcaaaagtgataatgaagacattctcataggcgttgggttccgagatcaattccttaaattttaaaagattcttgctatgatctcatctttaatccataatgtgctattcatttctctatttttccttgatgctccagaagtatattctttaacgtggctttacacaccaaagtagactagattttctgcctgttaatgatgatgggcttcttacttacagtatagtactgagttgtgtttcttattcccatcccgcaatgtgtgtatgtgtgtgtttcctgataatacaggtaaagcactgataaatgaagataaattgttggctttgttccaaaacaagcttattgttctaggaccccaaactgtctcaaacatcattaagaagcagcaggccacctaaggttgtgcatcaattagcaattaggtcacacattgggtggttgcaggcactcagcctttggccttgttcctcgcagcacactcaagcagggcaccagtatc

SEQ ID NO: 258664 - DNA, 283 bp, Homo sapiens
atagaaagaccactcctgcccaaaacagaactctccttctaacaccctgggtaatcattttccatcattttccttcctttctacctccatactaccttttactcctgtagaagcataatcctaaacccttcctaactcttccttgtgtacctgtatagtcctcgaatattttattttcacttatctcctctctcatttcttcaatctttctctttctgccccaaaaggtgcccaagtccctatttccaggagaaccctttcatttgaccccatccttctcagc

SEQ ID NO: 258665 - DNA, 1106 bp, Homo sapiens
atggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacattcagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaataaaaattttactta

SEQ ID NO: 258666 - DNA, 691 bp, Homo sapiens
gggcagatgccacaggtcctgggcaagaaaggggacatcagggatccccaaacccacagcctgtagtttcttcctcccctgcgattaccccattttatagccgtggaaactgaggctcagggtggatgtaaccacgcattcaaggctccaatagacttttgccaagttgctaagcgtttgtcttactcgtttgggtttggagcccccagcaccaagtgcacagccgggcaggtcctggaagcccaatggacaccttcttggcatccccacatacgagtatcaaaggcacctcaagttccttcagtcccaagccagtgcacggctcactctgtgttggcacaccccaacctctcctctgggacattttctgatcccggatggcagcccccaggccgcacgcggtctcttgagagccctgcagagccccaggcactttccgcgggaccacccagcactcaggagcctgtccatgctctcagtcccctcagccaccgccccctggcagcccctgccacgcctccacacctctgattccacgctctccggagcctccctccacgcagcagccaaagggggctttttgcagcaaaccgcggacgtgtcctctcggatggactctaccttgctctcattgcccgagggtcccgaccgctgccctctcaggcctcaggcctggatgcccgggcccttt

SEQ ID NO: 258667 - DNA, 1034 bp, Homo sapiens
ccaacacaggcaatatacttcatatttcacctcttccgaaaccgttcttcactcccctcatttctggctcagctcctgcccacaagtacccttttactatttagatcatctgaccttggtacattttggagtttcattgattgggcttaaagttggacttaacacttggcccaggggaagtacatgcattcttttattcctctcaactttttattttggaaaacttcagacctacagaaaagttgaatgaatggtgggtgaataaccatatgcccttccactagattcaccaacttaatatgttatcatatttgctcgcatttatttcattttcttggctggctaatgagaatcccaatgcagacatgacgttacttcattcctatgtacttttgcatgaatctccaaaaatcaaagataggtttttttatgttatactctgaaaatttaacattgatatggtactgttacctaatatacagtacctattaagattttcccaaatgtttcaataccttgtatagctgtttttcctcctgatccagcgtataataaagatttcagttcatttttcatgtttctttaatcatgaacagttcccccagcctattttttttacctttcataacgtttgacttttttttaaaggagtctacaccagttcttttgtagaatgtctctcaacttagatttgtgtgattgttttttcgtgatgagattgaggttaaacatttttactaatgttttgttaaggtgatatcaccagagttctttgtaaaagtactttttcctgtgtaatctgtggagtgtcattttaagaccgaatggatttcttattccctaacagtcttttactctgtagttttagcattcattgataatttttgcctgtatccattattaacttgatatttgtaatatggtgatgttctaattctgtcatttcttctatagagagaagatggttttcttatgtaaagaacaactttccttttttctcccaccatcaaaagaaataatttattgtcagcata

SEQ ID NO: 258668 - DNA, 362 bp, Homo sapiens
gccacctcagcctcctctgctaaaactactagccttggcacttagcttctcctgccttctcatcacaatagaggagactggcaggacctgccatctggtcctagaacattgcaacacatacccatctcagaacttacacatagcatgtgtgtaatacttttaacctcacttttctaagctaattcgtacacttaagatcttagcttaagcagctcatatttggagaagctttcccttacctctccctcccccatgttatataatctcttagctgctgtatttctccttcagatcatgtttaaactaattaaataatttgttgtgtataatgctcttattatttcacaatgcttgaggttgca

SEQ ID NO: 258669 - DNA, 289 bp, Homo sapiens
acaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctcca

SEQ ID NO: 258670 - DNA, 533 bp, Homo sapiens
cctacacccaggacatcttacgtgcactccttcctaccccctcccctagtgcttctggaccccgctagttcactcactctgcattgcaaaaccttccgcttcagccgtgatcccagcactcatcgtctgttgtgagcatatagctattgcttctgtacttaggcggtgtttgcttctcccactagagggaaactctgcctgagggatctatcaccaaggtattcattgttggggatgacatacgtgatgttatcgccctacacctggcaatgagatccctgtagaggtggtattaaagatggtcactgagattaagaagattcctggtatttctcgaattatgtatgacttaacatcaaagcacccaggaactactgagtgggagtaataaacttcttgttctattaaagtaccgtgtgcagtttaaattgattagaaatcattcaccattagtgacaggcagtactgtgtaaagagttatctggagcagctacatcacagtctgagttctccacagcaaaaagctactggca

SEQ ID NO: 258671 - DNA, 414 bp, Homo sapiens
cctacacccaggacatcttacgtgcactccttcctaccccctcccctagtgcttctggaccccgctagttcactcactctgcattgcaaaaccttccgcttcagccgtgatcccagcactcatcgtctgttgtgagcatatagctattgcttctgtacttaggcggtgtttgcttctcccactagagggaaactctgcctgagggatctatcaccaaggtattcattgttggggataacatattatcgcccaacacagacatcaaggggcctgacttctctgaataccgccgccttgaagttttagatagtacgaagtcttcaagagaaagcagcgaggctaggaaaggtttctcctatttggtaactggagtaactactgtgggtgtcgcatatgctgccacgaatgccgtca

SEQ ID NO: 258672 - DNA, 770 bp, Homo sapiens
tacaatcatacagactctttcaagcttagagctggagctcctggaagctatttcgtactctagtgcaagagcaaaaaaccacaacatgaaaggaattaagtcctgaattattggcttcattacatccaccatttccaccccaaaatgacccaaaagaaacagtgaccacaccctgtaggccttttggtgtaaaagaggtgatgaactggggcaagaacaggtcatgaagatttgtctataaaagtccttttcaggtgagtttgtacaccaccatagagcaattcgcctcatatcaattagggttaggaaaccaagtttcaattctcaggaagtcacaatttcattcatttactcaatatgaatttacaaagtgcccacatattaccagcttccacttgcagtcatttctagataaaaaagaagcctggtatctctagagggaccaccaagtttcccccaagcctacagctgaattacttttgcgataatttgtaattcctgtaattatttttccaaaaatttattcttattttactgtataaaagtattgatttgagtaaattggacattttttaaaatactggtatttcacatcagttagtctgagaatcactgctcgataaaacacccacattgcctaatgatgtaggcaaattacctgagtccttattaaaaatgtgtatattaagttctccctgtagaatgataatctaatggatataacattcaagcatcaaaagttttcttcttccctccctcagcatcttaaa

SEQ ID NO: 258673 - DNA, 359 bp, Homo sapiens
taactgcggtttcccgtcacgacagcataactctgttcgttatgtaaaactctcacggttactacttcaagcagatcatatgtatccctgtagatgataaccaagagagataatacttattaactgtataaaagtattgatttgagtaaattggacattttttaaaatactggtatttcacatcagttagtctgagaatcactgctcgataaaacacccacattgcctaatgatgtaggcaaattacctgagtccttattaaaaatgtgtatattaagttctccctgtagaatgataatctaatggatataacattcaagcatcaaaagttttcttcttccctccctcagcatcttaaa

SEQ ID NO: 258674 - DNA, 647 bp, Homo sapiens
caggatgggcaggatggagggagaaggaagggacagagagaaggtcagacagaggcaagggctgaagctgaggccagcacagaagccacaggaagccagaggccagacagcctggggcggtgcctgcaccgcagaactggtcccgggccgggcaagcaagcacagggagaggtggatccctgggggctgtggctttttaagcctgggcttcctcaggggcagtgctgcctgtctggggatcatgtctgcagttgacaagggctcggtctccccagtgccacactgttcagggcagtgctgctgtcccggggcccaggctggagctcagcagatttgccttgattggaggaggagggcatcctaggaggagagggagtgggggctacctcagggacggggaggtcaggctgcagaaacacataggccctgattgggaagaagggaacggaaaataagacttaaagaatttaaacaaaaagagccattgcagcgggatgagaccacatcatcaggttttgggaataggactttagaggcgtaggatccattacagcatcaccgaaccagaagcaggaaggctgagctaagcagagcagcagcagtggagataggaaggaagggagggaggggccgaggaaggaaggaag

SEQ ID NO: 258675 - DNA, 291 bp, Homo sapiens
cccagtcactctctacaaggtaaagctgtctgacttctcagtctagcaccaaagtcccctcagtctgaatctaacccactttctaactttagctctgtgcattgcctcgcttggaatgtctcctccagccagattcatatcattttaatcacccagcctatctcgcacctttcctctctctacattcccagtctttagatcctgactgcacacttcctcccaccaacttagaatctacccacccataaagtcgcgattcacgttctctttcaggaaggatttcctaaccac

SEQ ID NO: 258676 - DNA, 487 bp, Homo sapiens
ccacccttgcctggctttttcctgggcttccggtgccaacatcatcttagttacccctcaaaactagaaaaaaagacaagttacacctgattgaaaaaacaggaaacaaatgtaccagaagaactataccaaaaacaatgtagctgttcttagagaaaagttactggtgaagcagaaaaatctgtccttatatagcaatgactggggagctccaaataagattctgagattaaaaaaaaaaagtttcactacctcaaaatatagaattaaagtaaaccaggcttcctggaataatagaaatggcctgttatgctagaatagtttattataccctgaaggccctgtcatgttttacagtcacacacatgctatatctctgatgtacatttttaccactcaataactgcatttacaattaatgtgttttcaaacttttggatttttttcaagtttctatgaatattaaatttacaatagactcatgttt

SEQ ID NO: 258677 - DNA, 679 bp, Homo sapiens
tgaatggttgaatggatagactattctacttgtttaaattttaaatattatgtctaaataaatttcattctgacacttgagcttataattgagtgaagttcacactcagcatcaggaaaagtacagcctgacattttctgctaaaaaaatcaattaaaacaatttagaaagatgttttatgtaactgtaaagtgtttcattagattttttggatcttcttacaaaaatgcaacattttccagtatgttttgctgtttcttgcttcatttgcctccattctcccttccctctaattctcattgatagcccatgaaattctagggtcacaaacttaattcccaatgttggagtggaacatgtaacctgctatttacagaaataatatggtgtacttttagttaattgttccatattcttttcttaagtaattttgattttctattactaatatttctaaatctctaagacacgttctactcttctggtttctcgtgtatgtattgttccatcttcctttcaagtccatagacctccatatttatgtctgacccactttctctccttgatttgatgatcttgctgttcatcgattcagctattactttctctaggttcttgattttgtctcctgttgcttctctacagatcattgttcttagatgctgccatgatgaaaatt

SEQ ID NO: 258678 - DNA, 839 bp, Homo sapiens
tgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtggacgtcatggctaagatggcggagaggagcaccaacgtggccatcgccgagacagcagagggtggccaggggctggagatggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctgaaaat

SEQ ID NO: 258679 - DNA, 407 bp, Homo sapiens
acggagggcgcgtgctgccctctctgggggctctggccttcctttgcttgtggtctcaggaaagcacaccccgggcagatgtccgcctgctgcccatggggcccagggcaggaatggcccagctgcttatggccttattcttttgtgtgcaggacattaaattgcctccaattaggtccttcaacctctttggtgcttggatttcctgatctggtggggtctgtcggcttctcttcagtgcgatatatttaaatggataaaaatatgttagttcccaaagaattgtattatgtctattacgtcaagataccgttgttgaaatattttcaaaaaatacattagtgatgtggaaatgttatttctttactaatggaccaaataaaatctggtataatgggcacctttaa

SEQ ID NO: 258680 - DNA, 425 bp, Homo sapiens
ccacatcctccccttttttagtggcttaaaacaacatttttgttgagtttggagatctcttaaagaactaaagatagaactactgttggacccagaaatcccgctactgggtatctacccaaaaaaataataatagtcattgggctgggcagagtggctcatgcccgtaatcccggcactttgggaggctgaggtgggtggatcacttgaggtcaggggttcaagaccagcctagccaacatggtgaaacccacctctctactaaaagtacaaaaattagccaggtgtggtagtgagtgcctgtaatccaagctactcgggaggctaaggcaggagaatcgattgaacctgggaggtggaggttgtggtgagccaagatcgcgccactgcactcccgcctgagtgacagaaagagactctgtctc

SEQ ID NO: 258681 - DNA, 259 bp, Homo sapiens
gtaatcacaagggtccttaaaagagggaggcaggaggatcagagttagtggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacacaccttgatcttagacttctggtctccagaactataagaaaataaatttgtgttgttttaagctac

SEQ ID NO: 258682 - DNA, 398 bp, Homo sapiens
tatatatatatatatatatatatatatatatatatatatatatatatatatatatatatatatatatgtatgtatctgagacagggttatacaactgaattagagaatactgaaacattgctcctaggagaaatgcagaattagacactgtaagcctctggttataatattttttgtcaaccaatcattatataacctgttgtatgtgtgtttctgtatgaagatactttatttaatatatattgttgattcattaacactgaacttacaggtaacaatatgactcgcacttgaatgaagcaccaactgcagaaaggacacttgcttaaagtatgagagcttgcttggcacagtagctcacacctgtagtcccagcactttgggaggccaaggcgggc

SEQ ID NO: 258683 - DNA, 413 bp, Homo sapiens
agccctccctcctcccacaatatctctcatatgcattcctgtcccatgccttctgcttaagctgttcccacagcccggagtctcctccctggctgagggaaatcttgccggctcacatggccgtgatccccatcatttcctgcagaaagcttgcccagctctccgacacggggaccttctgcccctcctgagccctgagtcccctccatcttaactgggaggtcacctgtttgcgtggtgtctgctcagcttgcaggcaaggccaccaacaccctcctttcctgtctttccttcctaccatcctctcctgtccaccctctgcctctccctcccttcttctcttctttccttctagttactgagccatgcatgtgttgcatgcagcaaggatgaataaaataaaataaacctac

SEQ ID NO: 258684 - DNA, 510 bp, Homo sapiens
ccaggggaagcgtgtgagagagtgagaccgacagagtgagcacctccccaagccgctaccaccagccctccaacatggcgcctggcacgtcaccctaaaaagtcatttcttggagaagcgatggatgacagagattaatctgagagttactattaatggagaaacttagaacttaccatttttcctgtgaggtttcggtgctgatacttctattctgtgagttctggcaattgtgtccgttcacccagcctggtgatgcagcaggtgtcacagaaggaccctgtcccagctggtcctgctccactgctaggatggtgtggcctctgatctgtgaccgtgtcttgaggggagaccaggcccttgatcacaagcgtatccatggtgaggttccgtggatggaagctcatggatgttccttcctgatgttcatctgccaccttgctattgaatgcatcctgtttataactgtcttctaaatattgaatagaaataaagcatttgtacagtaag

SEQ ID NO: 258685 - DNA, 458 bp, Homo sapiens
gggcaggtagatcacgaggtctggagttcgagaccagcctagccaacatggtgaaaccccgtctctgctaaaaatacaaaaattagctgggcatggtggcgggcacctataatcccagctactcgggaggctgaggcagaagaatcgcttgaacccgggaggcagagattgcagtgagtcgagatcacgccactgcactgcactccagcctgggcgacagagtgagactcctcaaaaaaaaaaaaaaaagttgggggggtgtagcccctcccctttgctcgcttccctactgctccagttatataaaatgtgcttgcttgcccttctgccatgattgaaagtttcctgaggcctcctcagccattcttcctgtacagcctgtggaactgtgagccaattaaacctcttttctttataaattatttaatttcggtatctatagcagtgtgagaatggac

SEQ ID NO: 258686 - DNA, 202 bp, Homo sapiens
gatccccaaagggccgcagctcttctctcctcttagtcacccataaagtggcaagttgtggcggggtgctgtttcagccctgtttgtcttacagctcttctccccttctccttgtctctcgcaagtagcaaagagcagggaggggagcatgtctcagccctgttggtgttacagctctttttgtcctgccattcggcagatc

SEQ ID NO: 258687 - DNA, 1598 bp, Homo sapiens
gcgtctccgcagggaaaactgcggctggcggtgcgggaagtgctattagtagttgtttatttgtttgtttgcagaaataattgcttgggtacgaaggtcaaacgagaatgaagcaagtatattatctagtttgtatgtctttaaatagtttctcctccacacgtctaaacatacgcacctgctagtaggtgcgcaaatgttaaaacctctttgggaaagcaatgtggcaaaatctagtaaaagttttcaattactaaaccccagcactctgctcctacctatatgtcttgtagaaactttggtaagtgaacaaggatgtacgtaacagcgctgtgggtagaagcaaaaaattagaaacgtccatcaataacagaataaataccttatgggatgttaggatgtagtattatacgccaataaaagaagactgaactcagaaatgtgatgaggcaaaaagagaaagatgtagaaaaataaatagtatgacaattcatatacattcaactctaaaacttgtaaaacaatgctatatattgcttagttatgcatacatatgtagttaaagaagtcaagaaatacaagagaatgaaaatcaagttgagaaaagcagtcatatctggtaaggaggggacaataaagggaggctttaactgtattgaccattattaaaccgggtgttaaatatatgggtggccattgttttattcactacacctttaaaaatagatattattttcttaatgtagtttatttaaattgagataatgccatatacccagcatccagtttcccctattattaacatctcatgctaatatggtacatttgttgcaattaatgaaccaatattttacactgttattaactaaggttcacattttattcagatttccttcggttttacctaataccctttttctgttccaggattccatccagaataccacattacatttagttatgatgtctccttatatgcctcttgtggctgtggcagtttctcaaactttccttacttttggtgaccttgagagttttgaggagtactggtcatgtattttgtaggatgtcctaatcatggaatttgtctcatgtttttctcatgattgtatgtatttttaggatgcatttttaaaaagtcagctaagttaacaaaatcccttatcagactgaatataaataatatcgtccagtcgcttttgaaatttgcatgtcttcgactcactctcctgatgcacctgaaagttgtaatttctaagaactgcgtcagcaccattttttaaatgtgtacattctgtgaccatcgtcatcagcacttaacatcatttgctgaagaacttgaggaggaataggatttggtattgattccttcaatacgttgactcctccagactttcactgtaaccattagcccttggcttctagattgtctttaacttaattttctgtagttcattattacagtcactctgttagcactcacttcctcaggtcacttttcctttcccattactttctttctttctttgagaggttgcagtgagccgagattgtgccattgcactacagcctgggtgacagagcgagactttgtttgg

SEQ ID NO: 258688 - DNA, 536 bp, Homo sapiens
gggtagttacatgaaaatgtttaagtaggaaataacagaaattttctctgttatttctgcatagtagtttgatttaaggaaatcaaatagttcatgtgtcaaaatatagaaattaaaatacatgaaatcactttttttttttttttttttttgagacagagtttcactcttgttacccaggctggagtgcaatggtgggatctcagctcaccacaacctctgtctccctggttcaagagattctcttgcctcagcctcctgagtagctgggattacagtcatgcaccaccatgcccagctaattttgtatttttagtagagatggggtttctccatgttggtcaggctggtctcgaactcttgacctcaggtgatctgtccatcttgacctcccaaaatgttgagattacaggcgtgagccaccgtgcccagcctaaaatcacattttcataagttgctaatgtcatggacgtttagaaatttgcagaatgaactcctattattaactattcctaaaatagtttttttgtttaatg

SEQ ID NO: 258689 - DNA, 424 bp, Homo sapiens
ggtagatggattttttctatcagaaaaaaattatgcatattctacaacttgtcctcataaaatttaattcaacggtatatttttaaaatgcaaacttgagtttgaatttacaaatcagcctcttaatatttaactcaatgacaatgacttcattgatcttcctagtctcttggacttagcaggggaaacctgcttttttcccatgtgttaattacaaagctagtaaaagtaaattatggctaaaacatgagtacttaaaacaatctcaacttttcctaccatgcttagtagcatcagtagaggaggtacaaagaggaggtgagatgatgggagtggtgtctgagtggccactccttcccttcctgtccccatgaagatgggtaaatgcagccagaaacaaaatagattcacacccagatggact

SEQ ID NO: 258690 - DNA, 479 bp, Homo sapiens
acatagtgagaccctgtctctataaaagaactttaaaaaattagctgggtatggtggcatgcatctgtagtctgatctactcaggaggctgagttaggaggatggcttgagcccagagttcgaggatgtagtgagctatgatcacaccactgccctccaacctgtcttttaaaaaaaaaaagtagcatttaaaatttgggggctctattatctgtattacatgaatgttgagagaagtgaaaagctagaaattaaaatattaaggacactttttacatgactgatttagtcagtattttctacttcttctggaaaccaaaagcaatgaggagaatggggaaaatgttaaaaacccacaaatcccattttaagcaaaactaggaagcagatatgatctgcagacttcaaacaattttaagggttgccaaaagctgccaagatcaggcagaagctgtgcaggaagaaaaaggaaaaggaaa

SEQ ID NO: 258691 - DNA, 539 bp, Homo sapiens
gactaaggcctgtcatcaaatgtacaaaaattttcaactctagttctaaataactaggtcctgcctatgcttttcacatacatctaaaactgccatttgttaagtcagcgcaccccaaaattgcttcatcccatataaaaagagcactttcttgccaaatactgatttctcaaatgccaaaatgcaagcatatatcatgtggagacaaaaatcatcttacaatattctccaaagatgagataaacctctattctctttgcagagctaagaaacttttgctaagtgatttagtccaagcagtgacctgcacaacaacaaaaacaacaacaaaagtaatccaaaaatatcaggaagaggaatctaaaagttttaaataatcagggcggattctaaataaagcatatatttcagtgaaagttaagcagaattaaactaaaaaaaatttcatatgtaagctataagtaatacatatgcaaaaatttaaaaaaaatttaagccagaagcagtggctcatgcctataatcccagcactttaggaa

SEQ ID NO: 258692 - DNA, 262 bp, Homo sapiens
agtggaatatggactttgcctctttggctcttctgcttgcccagtgctttgaacagtgcctggcacaaggtgagtatttgttgaattcattccagctgaagactccagaccccgcaggtgtcactctgctataggtttgtcttgtccccttgctcaagggtcctgaagcaactcctaatatttaccccacagggggaatgagaaagaagcagtcttatcctagaatgctggaagaaatactcaacaatgataagcaatatgg

SEQ ID NO: 258693 - DNA, 464 bp, Homo sapiens
tacaaaaaccattgtgtcaaggtaaggagattattctggtttaatataatgccatttgaatgaggagtcagttttctttctggataaaccagttattaggtgaaatttacttcttgacagtgtccatcatttaaaagggactggaagaactcgtgttgaagtttccttaaaaatcaggatggggccaggtgcggtggctcacgcctgtaatcccagcactttggcaggctgaggcaggtggatcacgaggtcaggagatcgagaccatcctggctaacatggtgaaaccctgtctctactaaaaatacaaaaaattagccgggcgtggtggcgggcacatgtagtcccagctactctggaggctgaggcaggagaatggcgtgaacccaggaggcggagcttgcagtgagccgagatcgcgctactgcactccagcctgggcgacagagcaagactcggtctca

SEQ ID NO: 258694 - DNA, 418 bp, Homo sapiens
tcgtcgcttgcctaagctgctcccctaacacgccctcccgcggtcggggaggggacctggggatagattcccaggggctgggagggccaccgcagcctctgcagcggggcctggctgcgggtggatggttcggacaagtctcgaactcgccagctctgaccgcacacactgcatccgtgccagggaaagaaaagcctgggaaaggccagggtatggctgtaacactccaaggccttcaaaagggcagaccagcagaccaggagccggaaagacttccctgactttggtgccatccacgctacatctcctcttggtacacagtatgaacatgtttaattagacctagacaatttgtcaatgacccagcaattccactaacaaaaatgtattccaaataaataaacgttgttatgttaaa

SEQ ID NO: 258695 - DNA, 512 bp, Homo sapiens
agaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgagaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctaata

SEQ ID NO: 258696 - DNA, 364 bp, Homo sapiens
gctgcaccactgcttagtttcctggtccctaatactttaaggagccggatgggagtgagatctgaacaactcactctcactttctacaattctgtaagggtagggagtaggaactagaatggggtgctttttttccctgtgagaattgctatcgatcctgtggagggtttctcagccaggagactccatcactctggcctctctgaactcagagctcactcacctccctttcgaagctaacgtggcagagctggctgggaggtggttactggctcagggccctgaaacactgagtaattcctatgatggctgggactggagacaccattccagacacttccacgttgtctaaaagcaaaaaaaa

SEQ ID NO: 258697 - DNA, 353 bp, Homo sapiens
agcttgttaactgctggaaaaaccacatactggggctctgcagacccacagggtagagaatcccaggagccaggacttctgtttgaccactcttcaaatctgctagagccagggagagggcacggcatggccagagggccccactcacagagaattctgatactctgttgactggactcaccctcagacgggagtagcaattcgcaaagcaaatgctgtgttttctgagagacctgcccaacatttccatctgccatggtgggcttgtgccagaagccccaacaagacacactgggacttctccgagggccctctaggaaggggctgccacaaccattgtccctacaagaggt

SEQ ID NO: 258698 - DNA, 445 bp, Homo sapiens
aattcggcacgaggcagaatagagacagatgcacagagcaggccctgtgaggacagaggcaggtctcagcccggatcagcgtggtccaaaaggacttatcgttaaaagtgctggtcccagaacccaaggggaagacatgctggttctctgatgagctgggccgcctcctccaggaagcctcctccttggagctctgtagccatcgtgggcttgcaagagtcaaagggcctggcccacagcggcgcccggcactgagctggacagtgtcctgcccccaaaattcatgtccgcccagaacctcagaatgcaaccttccctggtagtagggctttgcagatgtaattaaggatctggggacgaggtcaccctggattgaggctgagtcccaagtcagtcactggtgttcctccatgaagagcagagcagaatagagacagatgcacag

SEQ ID NO: 258699 - DNA, 643 bp, Homo sapiens
tcacccatttctctccagcgctgaaggaaaccccccagatgcttctccactcacccaccgaagcaggtctcggttgcccccagccccgggccctcccgagaacactgcaagcccccactggtcccctcccggcaaccccacggcccatccccgacctgcactcaccctgtggggcctccaccctttggaggaaggacgtgtcaaagcttggaggtgcgcggcctgtctaacctccgcccaaggcgcgcggcaggcgacaggtctcagcccggatcagcgtggtccaaaaggacttatcgttaaaagtgctggtcccagaacccaaggggaagacatgctggttctctgatgagctgggccgcctcctccaggaagcctcctccttggagctctgtagccatcgtgggcttgcaagagtcaaagggcctggcccacagcggcgcccggcactgagctggacagtgtcctgcccccaaaattcatgtccgcccagaacctcagaatgcaaccttccctggtagtagggctttgcagatgtaattaaggatctggggacgaggtcaccctggattgaggctgagtcccaagtcagtcactggtgttcctccatgaagagcagagcagaatagagacagatgcacag

SEQ ID NO: 258700 - DNA, 251 bp, Homo sapiens
tgcgctgcccgggaggccttactgcttggtgtcagactgcccagctcagagtccccgtcagggcctgtgatccgcgtccgagttcatggtgcgccgctgtggggcctgctgcagtgggagtgtgtggaacaccttgaccaaaggggagctttgtcttgtgtgttttgaaaaaggcttaatgaagagaatgttgttcattcttagtagtatagtttgcaattcttaatgacaaatagtaagtttcagtagaa

SEQ ID NO: 258701 - DNA, 444 bp, Homo sapiens
ggacaaacagaatcatgaaagctgagagacagagagagagagagagcgaatcccagataacctacgaagaaagaacaacaattaaagcgactttcccattaccaaccacaggacagctgaaggtggaagacaatggagtgtcttcagtgggttaagaacaggcttgcaatgctgtaccacgctgactttcattcaaagttgagggcaatatgaaaagcattttcagacacactaaatgtgcttgctcataaaaaagaacaactaaaggatagctccagtaagaagaaaagcacacctagaggggaagaagtggcagaaagaagaaatgacaattaaataggtgagaaaagaaaagttttatgtgaggaatgcaagtctttttcattaccagccccagagagacattaaaaggagacagcaaccagtccccacttctccttccct

SEQ ID NO: 258702 - DNA, 465 bp, Homo sapiens
ttctctttgcctgaatatctcacaaggctaaaatcaaggtgtcaattgggctatcgttattccaaggttcaatcagtgatgagtccactttcatagtgactcaagtagctgttggtgggactcagttcctccatggttattcttaattggtggttggcaagaggcctacttcactgttttaccacatggatgttacccataaagcatctcacaacatggaagcagcttcaacagggctaataaataagaaggcaaaaaagaatgtgcaagaaaaaagtcaaaggcttttgtcatctagacttggaagtgattaagctcaagtgtgattaatctcaagccaactatcaagctgaaaggacaggatatgaatattaagaaaaggggatcactgaaagccatttaggaaactgcctacaaattatgtggatatggatgttttacgaaaataaaattccttgtcttaga

SEQ ID NO: 258703 - DNA, 820 bp, Homo sapiens
gattaaatatgtgagtcctctttttaatggtgctttttgtaacctttaatgctgaggtacagagctgcttttcaatatttcataaaggagtggcagacaagagtggattttaaagctgttcttcaaacgtaatttgtcactggactctgacacacctggaaattatatgatatgatacatacagaaatgttgtgggttttttccataaaactttaataaaagtattatacagccaaaaaaaaaaaaaaaaaaaaaaaaaaaaaagcggccgctcgaattcgcggccgcgtcgactacggctgcgagaagacagacagaagggacaattcactctggaacaccctgcacagcaaaggcatgggggctggagatcacatctcatgccaggaacagtgagtgggcagtaggaggtgcgacagacggctggaggacatgggtgggtagcccagatctcagagagccttgaatgccaggcctgggagttccaactgcaatttctataaagctacgattattaaaaatagataaaatgtacttttatgccaacaaactatccaactgctttcctaggaggtggtaaacaaatcctatcaccctgtttcaacagaagactacaccatggctcctgatcacacctaaaattccacgataatcacattaaacaatcttttatttgtgttttattacttaaaaaattttatattgtttattactaaaaaaacaaatacacacaacgtgaatgtacttactgccactgaactgtgtacctaaaaatggctaaaatggaacactttatgttttgtatgttttaccaaaatta

SEQ ID NO: 258704 - DNA, 351 bp, Homo sapiens
gtgacatatacacacaatggaatattactcagccttaaaaaggaggaaacttctgatatatattacatcttggatgaatcttgaagactttatgataggtgaaataagtcagtcacaaaatgacaaatactgtgttaccccacttttatgaactcctagaataatcaaatttaaagtggaatggtggttgccaagggctggaaggcagaaggaatgggagcttattggttcttgtttttgttttgtttttttttttttgagacgggagtctccttctgttgcctaggctggagtgcagtggtgcaatcccagctcactgcaacgtctgcctcccaggttcaagtgattctc

SEQ ID NO: 258705 - DNA, 131 bp, Homo sapiens
agcaaatggcagagctagaatccaaactcaggccttctaaattcagtacaatctataacaaactgtgcaagagtaaagaccaaagagggcttttggtctcttggaaaaaatattttaagccaccttaatag

SEQ ID NO: 258706 - DNA, 580 bp, Homo sapiens
gggccattatccatcctaggcccaacggcctccaagtggggtttccagaattccagaacccaaagagaggagtgtgggaaaggctatctggtcaccaaagtcatcagcaactgcatgggaaggagctggacaatgagcatctcctgtcaggcttccacatgggctgaagccattaggaggccagaggccaggggagccctttaagacagctcagcctcctgggacaaacagcagggtggaaaagggtggagacggggtaggggagcaattggaagacatccaacatacataactggctaagataagtcttagctaagcagaaagtaaagtccatgctaaatggtagggataagaaagtgatatgggtgcagagctgtgaacagcagagccagtatctgcagatgtgcagagcaagacaccaaaagggatttagtccccctgggctccatctgccctataccaaggtcactctctcagactgttgtggccatgggctctccagaactcactgagagcagaacattgccttttatttctttcatgttcctccacagcacccaatacaatgtgattaacttca

SEQ ID NO: 258707 - DNA, 419 bp, Homo sapiens
catcaccttaaatatttatgttttctttacactaggaacattcgaattctctttagctattttgaaatgtacaatagtttagtgttaatagatcagtcatcctactgatatatcgaacaccaggtcttatttcttctgtctacatagacatatttagaaatgcaaatctcttaggaaattaatctgtaatgtcgatgcacactgatttgtattacttgctttctttgtaggcagtatagtgaaatggttcattaaatggatgctaaatatgactaaatgatcaatttacagtgtagttggcaccaagtaataaatgctcagtaacatagctactatggctgtctttaaaagtggattggtttgacttcataggaaggactctatttttaaaaaagagaaatattaaaaaataaaaagcc

SEQ ID NO: 258708 - DNA, 397 bp, Homo sapiens
tcacacactttaattcctaattacacattgtctttttatagttttttagttgtgtgtccttcctcaagggggaaggaaaataacattcactatgtgtttcccaccatgtgccaggcaactcacaaaggttatctcagttaaccacaggacaaccgcatgaagcagatgccatgagattcaatttacaaaggaagaaactaatgttcagaaaggtgaagagacttgcccaagaccaatgaggtagtaagtggcagagccaagatggatgggtggatgaatggatgggtgcatggatggatggatgggcagatggatgggtaaatggatggatggatgggtggaaggatggatggatggagtaatggatgtttggatggaggtgtaggtaggtgaatag

SEQ ID NO: 258709 - DNA, 466 bp, Homo sapiens
gactagcactcttcttcctcaaccaccccttcccaagacacacacacacacacacacacacacacacacacacacacacacacaaaattccccagagtgaacttttgccaactgtaccagactgggacattcctcacatcaaagaacttttaccagaaatgactgtgattcccaagctagcctcaatcatacctctctagtgccctctacgggaaatttttaggaaaactatcttgggaatgtatttttccagtcccagagagtgttaaattggtgagtttggaattcttaggatgctttttctttttaatgagggacaaataaatgccacatatttaaccgtggttaactaggaactgcttgactttgagtttcttttttgttttcttctaaataaaacctggttaaaaaaggagtgctttttcgttgtgcacaagtaccctagaacttaaagtataataaaaaa

SEQ ID NO: 258710 - DNA, 680 bp, Homo sapiens
ccctggcagtatgtagccttaccagcagtgggtgagagtcccatgtccccacattctttctacactcaatattgaaagccaggtggtttttttaatgtaaagaggagagaaagagagattcagagaggagagcatgtaaatggtgtgggggcacaactgtagcttgacgcagccccaggcatcctggggtggagggtgaggcacacatgtgctgttcccttggtctgtgtagttccaggccctccacagtaagaggcttccaagggtggtaggaactctgcccacacgctgactttgcaacctcaccttcagcatgccgtggatgccgttgtctggttcgggatgtgggactagttctgatcacacaaggtgccaactgatctcctgatgcgcaggtttcacagattgcttctgttagaaagaacagaggccgccagggatctctaaaacacagcatcaaggaactcactttgggacaagctccccaaactgccagctcagtaagggagctcagtggacgggattccaagcacacagcctgagaagctggccgagcttcctgggctcatccagggctgtcgggcaccccccacaccgctgatgccctgggcctcatctgttggccagggaagttcagtccagggaggagtggctctacagggggcaccctgggtggcttt

SEQ ID NO: 258711 - DNA, 498 bp, Homo sapiens
ccaaagagcaggaacttagattcatctccaacagaaattagctggcaaaacaacaatctaaacttagctgaaagggagaacacaggcttagtttccaccagattaaaaattaaaaggtagctttcaaagccaagacccaaaagaaggccttgagctcaaggtgtctgcccttatattagaagtataagactagggagacaaaataatctattttaaaaaattaaatacaaataaatcgaaaatgcattcaaatgtctccaagtggaaatgtgtctaagtatattaaatattcctgctttacttatatcaatcaagaaatgaggataaaaaactttcaagaaaagcaaagtgatttgagatgccagtaatacaaattaatctcttgggttagtaattcagctgaaagtgtaacgacaataacaaaatgtaaattcaaaggaaatttaaaagcctgaggagttatttcagtggaaattcttaataaaactattatattat

SEQ ID NO: 258712 - DNA, 481 bp, Homo sapiens
ggtggggaaagccttaacacatcctgaaaaggtgcaaacaagcactagcacggactggtagtccacagcatggacagttctgttaagtctgtaaccacgcttttacaaggcatggcttctacttcccgaattcctgggggccaagtgggcccctgttgcgggttgttttgagcacaggttaagcactgtttacaaatggctcaagtgatggcagagagccgtggcacatagaaatggcattttagtaacgtttctagtgccattttttccatgagttccttgatgaatttgctttacaaacatatgagcttaaatctttgaaatggctaatctcccatcgaagaatttccaccaccctccttgaatatatttttcagcctcctgggcaaaccagggtctttcatttggtgtataacttgggttttcttggagaggaggttctgggaggagagccatagctaaggcttcctctgatttaaaa

SEQ ID NO: 258713 - DNA, 494 bp, Homo sapiens
gcacgagcattatcttgagcatatataggttgtaaattaactgtacactcacataatctcttgttgggagaaaattgcataagtacctggattgtctcaagattcaatcacagaaacttctaagcagacataattagataagtgagcagtgcaagggagtgcctgggggaaagaaggagagtaaaggtcattattttattattaacaagaaacaggcaccaaataagggagggaagtaaaaaagaaaaaaaaaggacaaaaaaaaaacccttaaaaataggttactcggttacaacaccactagacttggaaaagttactaattgtcccctcagtccataacagatcattcgagggtgggagatggtggaagaatgaggaaacactggaagcatttgtgcaaaagtcaggaacattgcaaagatacccactggcgtgactattatttaacattgtactaaagggagccagctgagagagatactagaagttagg

SEQ ID NO: 258714 - DNA, 511 bp, Homo sapiens
acttgtatatcaatgttcatagcaacgttattcataatagctaaaagtggaaacaacacaaatgtccatcaactgatggatggatacgtacaatgttgtacatccatataatgaaataccgtttggcaataaaaagaatgaagatctgatacttgatacaaaatgaatgaaccttgaaaacattttttatgtggaagaagctagtcacaaaggactacatattgtatgattttatttttatgaagtgtctgaaataggcaaatctacacagatagaaaacaggactgggagggagtaggaggcggttgggggtgatggctaaggcatgtgggtctttttggagagtaatgaaaatgttgtaaaattgattgtggtgatggatgcataactctgtgaatatattaaaagccattaaattgtatacttcaagagggtgaattgtacagtaagtgaattttatctcaacaaagctgtttatgaaaatcaaatgaactaatccttagagaaatgc

SEQ ID NO: 258715 - DNA, 471 bp, Homo sapiens
ttctgccctttctccttcccaaggtgcttatcactcagtaaggatgactgcacacctaccttacaccaggcaagaaggaagccagaaatactgatggagctttctttggggaatccaagtgggaacctgggggagagggaaaaggggaggagttccctttcttccctacatagctccctactgtccagtttacaacataattggctagggaggctggactagagggaagacacttctacaaattacccagcaagaactgtgtgttaaggtgggtgtggtagcgtgcacctgtagcctcagctactggggaggtggacgggggtgggtgctgagttgggaggatgttttgaggccaggagttgaaggctgtagtgtgctgtatttgtgcctgtgaatagccactgaactcctgcctggacagcataacaagaccccatattttttaaaaagttagaaacaaaagaagaagaa

SEQ ID NO: 258716 - DNA, 123 bp, Homo sapiens
gcagcaggtggtaaagaagtatgaactgaaactgccatatggcggtgtgaaggaaatgtttctctccagagaaatacttgaaagtgtcataaaaacagtaaaaacatttaacagctcaaaagg

SEQ ID NO: 258717 - DNA, 361 bp, Homo sapiens
tatcttgcaatacaaactagaaagaagttatctgtgaaattattttttgttgtgtgaattcagctcacagttaatccttgcttttgattcagcaggttggaaacgctttttttgtagaatctgcaaacggatattttggagcccactgaggcttatagtgaaaaactgtatagcctatgacaaaacttttgatgaaaccatgtgtgaaactactttgtgatgcctggattcagctcacagacttaaaccataccattgattcagaaggtttgaaatgctctttttgtacaatctgcacaggaacatttcaaagcacactgaggcctatagtgaaaaaacaaatatcccacaataaaaacta

SEQ ID NO: 258718 - DNA, 574 bp, Homo sapiens
gtgtgtgtgtaatataaattcatcccaacaaataggtcaatttgcttattaatattccctttcatgtttgagaaaaaaacccatgaaaacttaattcagtgggaacagaagtgaggaagcctgttggggtaagttactattaaagaattatttaaatgaaggctgggggcaaattgtctttctttctttaattccatgagcctgaatggtctaaaagatcttatttgcccaaaatagaggagctgaccacgtagttcaacaaccaacttctgttttgtagtcttcaaaaaaatgctgggtgattaaaatatgtgtcatcatgagtgcagggcaggaaaaggcaactcatataaaatgccagcttgagactactacacggaagttgcacaaccatacacttaaaatctgaagtgtatatactcactcctgatggctgtgagaaaaagtgaaagcataagtcatggatttgagaattttaaagttcttaaattgcatgattaaattttatcagaaataactgtattgctctcataaaattgttttaattaaaacctaatctatactttgtattact

SEQ ID NO: 258719 - DNA, 445 bp, Homo sapiens
atgtgggtactttgcaattgtgtgtttgtaactggagcaattgatctatattacaatctagaaactgaccactttggcaatttaaactgtttttactcctgcttctcagataaaggaaaagcttatttttaatagcattttccaggatttacgtagctaacccaatatcacaggaataagatcaccagtgggctgaatcttagaggtctaggcatcccattttgaccccagagtcatgctgaaaaataaaggttttaaaataatatattaataataataagatagctatgatgttgtgagagctataagaaaaataacagacaataaataggactagaaaacttccatttctgaccaggcgaggtggctcacacttataatcccagcactttgggaggccaaggtgaaaggatagcttgagcccaagagctaagagcttgagacc

SEQ ID NO: 258720 - DNA, 264 bp, Homo sapiens
ttcccacaatgagttgaagattgtgttattcacatcttaactgataaattagtagtaagcagtaaaagccagtgcaaaggtataaggcaaataaaaatgtttatttaactgtttgttttctcttcctgtagagatataagtgtgtctaattttggtgctttcttgaggaagcatagtgatagataaaaccatcactctttttttttaaatgtcactgaaaaaccatccatgcaaatttgaaggaaactcaacagaaatgttaaa

SEQ ID NO: 258721 - DNA, 467 bp, Homo sapiens
ctgctttctgtgctgttctcaacaccagggtcctttcctccagaagtgggacctcttaagtgtgagaaaagaacttgttcttttaagatggtacctgaatgacttttgaaatttaattagaacctgtagtttttcaaagcctcctgttatagaccgaatggtaccctcctacattcatataccgaagccctgaccctggcgtggctgcatttggagatagggtctctaaggaggtgattgaggttaaatgaaaccataagaatggagctccaatccagtagtgctggtgtccttgcaaagaagaggaagaggcatcagagatgcacaagcatggagaaaaggccatgtgaggacacagcaagaaggtggctgtctgcaaacctggaagagtgtcctcactagaagccatccatgctagcaccttgaactccagaaccatgagaaaataaatttctgtttttaagcca

SEQ ID NO: 258722 - DNA, 435 bp, Homo sapiens
attagatgatgtgagtattgcattcctcctacagttctttgtgattgtgctaagtgccaggctgggattcaaacatgagaattttgattcaaaacctcatcctctttcctgtttactatgcaatctccaagctataaatatggaaatacagaaagattaaacatttgtgataaaactgtgctgtcatttttatattccctgaaaaactgatctacccatcctcctttactcccttgccaggcatcgtgccaggtgatgggtgcataatgaagaacaaactagccagagtcacaccattatgggcatgagaatattgtcaagtggagcaagactggcatcaaacaaatagaaagcaatatgtagttaaaatgtacacaaagtgctaggagggagaacagaggtgctaagaggtatcattaaagggggccgacttaa

SEQ ID NO: 258723 - DNA, 511 bp, Homo sapiens
actgggcatctatccacagagcacatagctgtacccgtagatgactccccctccccaggtcagcctgcgatgtttccccttagtcctcatgcgtactgagcatcacatgggctgcttgggagaggtggagataagggaggggggctggttcagaacccaggtctccattcagatcctggctggccaacaccctggggcagagtggccacacccctggtgccacagtctcctgtcttggcctccctgtggccaaaatctacccttggccacctcaagcatggtagtgaggagtcagtgagctatagtacagcaggagcacccagggcctggcatgagctcaattctgtatcactgactcaggcctcctaggagccttggagcatttagtcagtcaagtgtcacaaaagaatggaaagtgtcagccctctaggagttgggggtggtctggaaggagaaagctcttccaggcagagtggggcttggctcacacatcattgctggtggttggatg

SEQ ID NO: 258724 - DNA, 506 bp, Homo sapiens
atatcaactaatcatcaagtttgccaaagcaaaaaaaaattgaaatataattcctagttaattggtttaccattcattattacttctctttgaattcagtaacttatcaatgattaaagatgtgcttcaacaagttaattctttaagttcaaataactggaaaccattttctcaatggtgcagcatttcttaatgtcagttcaagatgtttggagacatattgctgattttagaagctgatgtgtgctgatttatgaaggaattgtttagcttgtactctgggctctgatcaagggagatacactctcagatacagcctggcatttaagggtacctctttcctagctgattatctgcttcctgagttcagttgtaatagcttgcgagcttctcccatcccatatgactggattctgatttcttattttctgatagcagggtaaactttgttctcccttattactaaacgttgacttgacaaataaatagacctcctgcattttaat

SEQ ID NO: 258725 - DNA, 709 bp, Homo sapiens
gggtcatgggggcagagctctcatgaatggcttgcagctgttctagaggtaactgaacacttgtattaacagtagtgagttcttgctctcctgagactggattagttctctgggaatgaattatttcccacaagagttggttggcattaagtgagattccttctcctgtttgatccctctttgcacgtgtctgtctcccctttgtgcatctcaccatgttatgatgcagcatggaagcccttgccagaaaccagggccatgcccttgaacttcccagcctgcagaaccatgagctaagtaaatgtctcttctttataaatcacccagtctcgggtattctattgtagcaacaccacaaaacagattaagactggtcctaagacataaataagagaccagatcaattgctttcatgctttaatcctgtgacaagcttacagtaagctacaagatatgcaaaacaggcatgagactgatggtgctcagagactaatcatgctctggcagagggaaatttctttccaaataattgaatggagataccagttgttctgaactactgggcaagatgttgttacttgctgtgtaaggaatatataattcagccacacatccacttgcaggaaagagctgtctgctgcttgcttgttgaactatggaagcagaatgatatggctatccacagaatggttcctgaaaaacaccacat

SEQ ID NO: 258726 - DNA, 817 bp, Homo sapiens
cggggaaatttagtatgtccttaatttttaaaaaaatcaacaagtctcttatactaattgagataagtataaccaaatgaggaaagagattatcgttaagaatggtaagcaaatttaatttcctatgacaaacataacttaaaatattcagtggacaaacattaaaaaatgatgtcccataaatgtaggctcaatattactaaaaaatctgaatattactggaaagttactttccctttcttgtaatagattttaatagaaattcaactttatgaagtaaaaatacataaaggcttacctcttattttatggtaactatgcaaacatctattaacttttatggataattctttttgaacaaaactaatctcatattttggattcttaaaatggctttggtttcaactcgttttaggcaagcctgatcaaaacttctcaggttttatttttaatttgtgcgataggattattatttttattttgtttagctgtactaatcatttttagaagaaaatgttcctttcttgataaaacttttaaaaaaaatacattttgtgcagagttcttaatttccataacagcccacctgatgtgtaaaatatgttggtgcacagtaaaatttcacagtgtgtgctttcctgtccttctttttcctggtatagttggggtgtaacttgacttagacactactaattgttataaacctccagtacccttgatttgccaaataagtttgaagaacaaagtgtatcattttctgttaccttaactctcacaatgctgtatcacataataaagcctcaacagacttggatta

SEQ ID NO: 258727 - DNA, 315 bp, Homo sapiens
atctatgaaggagaagacaagccctcaccagacaccaaatctgctgatgctttgatcttggacttcccagcctccagaactactatcgatttacagcaatggattggtcaaggaaggataaagaaacttggaaagaactatcatgatacctgccctgagaagccaaaatttggtttaactttgtgttgtttactgtttggttctataaaagctaagtttataaaatattgtatgacaggtgaatttaaatgttactaaccatcttggatgtcctgctcttctgctgtacagcaataaagtctctctaaatgcaat

SEQ ID NO: 258728 - DNA, 230 bp, Homo sapiens
catgagcgtggaagaaatttacaacaggacatttgttgagcaaacacttacctgtcacctgttctgtcttagttctggctaagaattggtggtctaaagatgagccaggctggggcagtggctcacatctgtaatccccagcactttgggaggtggaagtgggaggaatgcttgagcctgggagtttgagagcagcctgggcaacatagtgaggccctgtccctaaatac

SEQ ID NO: 258729 - DNA, 387 bp, Homo sapiens
gaggattaacactaaggctctgtcccctgatttccatcccagtggtctctttccagcacacaggctgtgccacagattttataggcatctggaattttgctggcagggttacttctaagaaatctttcggtggaatctctttaagtggcccctggaatgtaagcactatgggcagtctgtagtgacccagagctccaaaacagagtttctaaacaggcatggcagcaaatcccagcaacatcaggcagatgctttagacatttaaggatctgcagatactgcagaatccctcagttgtgtggtcagcacattacaactcacataactgtaaaattttgctgcaataaaaattatttttataataaaaaacatactgttataaaagta

SEQ ID NO: 258730 - DNA, 448 bp, Homo sapiens
acatacactgaagcactttttagtgtgctctatcaattgaatattatagtgttcatattggctttttataataggtatactactattattgatattaacacaataatgtgttcaaactattgaaataggattacttaaaaactgcgttaatattcaatagcttaaatctgaattgtaattacttttagaactttatacactaagtgatttctaaagtgactaaaatagggaagaatatttcttgttttgaaggagcataatgatttgcaaatcatggatgataggttcaaagaaaaataattggttgaaaaacaaactgttgggtaccatgctcactatctgggtgacaggatcattcatactgcaaacctcagcatcatgcaatatgcccatgtaacaaacttgaacttgtacccctaaatctaaaataaaagttgaaattattaaa

SEQ ID NO: 258731 - DNA, 488 bp, Homo sapiens
taaagtagaataggaggcagaagaggagaaacagtcagaggaaagtgtggctacagaagaaaggcacagagatgccatgtggtggctttcaaggagaacgagacccatgagccaaagaatgtgggtgccctctggaagcaagaaaagcggttctcctctagagccttcagaaaggaacacagcattcctgacaccgtgattttaacccaatgagacccgttcgaacttctaactacagaaatgtaaggtaataaatttgtgttatttaagccactaagtttctggtaattcattaaaacagcaataagaaactaaaaatatgcatcaaatcaaaatctctgaatataagatcaaggaatgtgccttcttatcaatttcccgggtgaatcttttgtactctaacattggaaaacaactggtctcgagcagtttaaaaaaaaattgaagatattttaaaggaaagataaatttcttacctttataatgta

SEQ ID NO: 258732 - DNA, 390 bp, Homo sapiens
agttaccccttttgagaaatctgtgctaaaaggacccaaacaatgctgatgacaatgatcaggataataagtacgctgggaagagaacaaaatgatttagatcttagacaagtcattctaggtgtctccactgtttcagttctcgcgttcgttcattcttgtgctttttcgttttaccaaataaaatagccccttgatgtcatatgaatccacgctatgcttaatgagtattggttagtaaaatgcctataactagtaatcttcatctatgcaattaaatattaattcataaaacacttcaaatgtaaacaataattagtaaatgaaaagtacataatacctcgattagaaaaaaatcactccattaaaagacattatttgtgtgataaa

SEQ ID NO: 258733 - DNA, 554 bp, Homo sapiens
ttcatcattgaatgattgacaatatttatgtataaacttgataaagatcatttgagaataatctttgttttgtgttactgtagctacataagagaaagaaattgtatatattaaatctctcattgtatctagccatagctaaaataactgctttatagtgggaaaaaaaaagattattttattttggaaataagtacattttcaagtttgaatcaaaacctttcacacttactaaaatatatctgtacacacaaaaccccagagtaaatattcacattcatgtcacctccctataataactacatttactcatatttatttctgtgaataggggttctggaaccattatagtagctaaaatgtggtgcaggagataagagtgtttaatcaaggttcacaatgatttgcaatggcaggagacagtttgtggctagagataacattcagcagcacgtgtttatgagtgagatggacacctgtctgatagtaccatgagccagcctgtgtgctttgctgatgcaggtagtgctgaaagcattaaaattgtgcagtga

SEQ ID NO: 258734 - DNA, 249 bp, Homo sapiens
gaggggcgaatgaggcagccaagtgggagggggtccctggaaaaactccaaccagcctgcacactggggtggagccttgggaagttcatgccatttgcaacagggaggtgcctgactccttctctctgtgtggaacctgggattcaagttgcgagcgggaagcgctctagcagggactctggccttgtgagagtccctgtttcccccctttctttctttacatccaataaaaccctgtcttaccattca

SEQ ID NO: 258735 - DNA, 392 bp, Homo sapiens
gaccaaaaacccaccaattccggacacagtattagccgactttcccattttcccccagtttcatgaatatgaagtggatggtacatcactgtaatttactctttcctagaattttaccttttccctgaattttacttattcaaggcttttaaaattctctaaaccagtattgttcaatagaactttcttgccagggtggaaatgttctccctttgatgggtttctttccactttagtgagtcctctaaactgccatccattttcctacaaaggaaatctgatcatgtcaactaaactttaaaatgtgacaaaactggaaaaagtttagattatctgtggtttatttattgcctacaggctgcaccaaattataaagcttggaccacaagggt

SEQ ID NO: 258736 - DNA, 647 bp, Homo sapiens
ttcagatcagttaattactggtatgctgcccctccccagtcaaggatcttttattaccctaccatagaatcacatttctttccttagtgcacttctctcacttgagaaatgcccccattaatgttattacttgattaatatcgacctcccttttctccttccagggctgaaattgtgtctggttttgctcatcatcttatagcatatagcaggagtgtaataaacaattgcttaaaaaaaaaaaaggaagcaggtctccttggaagaatggctgactccaaggctggggcagagaaggcgtaaggtcctgccatgagatgatacagcaaggaggccctcaccacatgccagccccttgatcttggactacccagcctccaaaactactcctgcaagatgagtagtcagtgacttcctgagtagaaatcaaatgatctacaatggttttaaaaacagagaacagaagagtaaagctgaaaaatactttgtcactggccaggtactccctttagaagcaggtcacctgcctgtggtcccagctacttgggaagctgaggtgggaggatcgcctgagtccagaaagtcaaggctgcagagagccacattcactgcactccagcatgggtgacagagggagaccctgtctc

SEQ ID NO: 258737 - DNA, 518 bp, Homo sapiens
ttcagatcagttaattactggtatgctgcccctccccagtcaaggatcttttattaccctaccatagaatcacatttctttccttagtgcacttctctcacttgagaaatgcccccattaatgttattacttgattaatatcgacctcccttttctccttccagggctgaaattgtgtctggttttgctcatcatcttatagcatatagcaggagtgtaataaacaattgcttaaaaaaaaaaaaggaagcaggtctccttggaagaatggctgactccaaggctggggcagagaaggcgtaaggtaagtctgggccaccttgttgtgcctgaaaatgggaaaatgctcagagtgaggacaggtcaaaaggaaaaaggaatcagcctgaggagctcccactggtcagatctggagcaattcagcatcaagataaagactgataataacagattataatccattaaataagaatctaataaagggggagaaagctctcagagtgaaacgacagctgatg

SEQ ID NO: 258738 - DNA, 371 bp, Homo sapiens
tctccctcactctctcttgcccttccaggtcctgccatgagatgatacagcaaggaggccctcaccacatgccagccccttgatcttggactacccagcctccaaaactactcctgcaagatgagtagtcagtgacttcctgagtagaaatcaaatgatctacaatggttttaaaaacagagaacagaagagtaaagctgaaaaatactttgtcactggccaggtactccctttagaagcaggtcacctgcctgtggtcccagctacttgggaagctgaggtgggaggatcgcctgagtccagaaagtcaaggctgcagagagccacattcactgcactccagcatgggtgacagagggagaccctgtctc

SEQ ID NO: 258739 - DNA, 523 bp, Homo sapiens
  misc_feature (23)..(23): n is a, c, g, or t
  misc_feature (76)..(76): n is a, c, g, or t
attcctctaccagattgtatatntgaagccagtgtctttccttttttgttttaagatagagcctcgctctgttgcncaggctgaagtgtagtggcacaatctcggctcactgcaacctctgcctcccaggttcaagtgattctcctgcctcagctactcgggaggctgaggtgggaagatcatttgagcccaggaggttgaggctgcagtgagctatgatcttgccactgcactccagcctgggtgacagagtgagaccttgcctcaaaaagaaaaaaataaagaaaagaaaatctgaaagggaaagcaggcatcaacttccagggatctaataacttcctaacttaaagcaacagaacttacctaacttttggacttttcattttaaaactttgcctctagcagtggacactgtcctcaacacagctacagtttatgtaacacagagtccatattatatggggcatgtctgtatcaaaatgtcatatgtagaaataaagtattaaatattaaagtggcataa

SEQ ID NO: 258740 - DNA, 354 bp, Homo sapiens
agttgcatctgatgttctatgtattttttgaacgatttcttcttatttgaaaaaatctttctttgaggccaggcacagtggctgatgcctgtaatcccagcactttgggaggctgaggtgggctgatcacctgaggtcaggcaggagtttgagaccagcctggccaacgtggtgaaaccctgtctctactaaaaatacgaaaaagtaactgggcgtggtagcatgtgcccttaatcccagctactcgggaggctgaagcagaagaatcgcttaaatccgggaggtggagactgcagtgagccaagatggtgccattgcactctagcctgagagacagagcaagactccatctca

SEQ ID NO: 258741 - DNA, 206 bp, Homo sapiens
agctatgaccccccttcttcctttcccaattaaacttcttgaaacacttgtcttcactgaccgtctttgcttcacagattccgcttttgctagatcaacaatacatcttgtttgtttttgttttgttttgagatgaggtctcgccgtatcactcaggttggaattcagttgtgtgatcacagctcactgcagccttgacctcctgg

SEQ ID NO: 258742 - DNA, 408 bp, Homo sapiens
caaatgagctgctttgctatatgcaataagtgtgtctgaaaaaccactctttttgctttttggttaaaaaaataatatttcccatttcttaaaatgtttgatgtttcagtaagttctatagttaatttttgttgaaacccacaaatggatccatgaaaaagatagttcactgattatctttggtggtgaggggcctctgagaatttcaaatgagatagtggaaattgctttgaaaactgtaaagaattatacaaaactaaggtactattttgatttggtgacagtacaaagaacagcaacgaaaatatttgcattttggtcttgtctaaagaagtgcacagatgttttgttgggatgtattgaaaaggaggagtaaagaaacacccacctcttaaccccacgaatgag

SEQ ID NO: 258743 - DNA, 349 bp, Homo sapiens
agaaaggctcttaagcccaggcctttttgcctcatgtgcagagtattaataacagccctactgatgtgaacctcaaggaaggaggctattaaattaatccatcactggagatactaatacctcaaacaattaaaacactgaagactctgctggttgccttccacattgtttataacctttttaaattcagtcatttggatcaagagaaataaatggttggtttcatatggcttttgccacattagcacagacacatctaccaaatgtagaagtccagactgagtggatgcatgagagcaaacagatctgtaatatgattgcatttaatcaccgcccgcccaaattctgt

SEQ ID NO: 258744 - DNA, 212 bp, Homo sapiens
cccctgcccctctgagcctcagatgggacgctagaccctccctgattatagtctgcgagacactgaacctggactcctggtctatgggagctgttttaagttttaagctgttaatttttggtaattagttatgcagcaaatggctgtgttgttattcccatccccctcttcccacctgtctcctttaaataaaaaccagcatttcaggtctg

SEQ ID NO: 258745 - DNA, 278 bp, Homo sapiens
cctgctcataaccctaaacctagcctgaatcctagccgtagccatcacttaaccctaacttaactctagtcctatccctaaccctacccctaaatcaaatcctaatcctaaaaacagccctagcttcaatcctaactctaccataagccctactctagccctaaacctaatgctaaatctaagtgaggtttgcaaaatgaacccggtgaagctgatactaaactttcctcttttattctgttgcactcaggccaaatgagtcttgaggagttgggaaa

SEQ ID NO: 258746 - DNA, 338 bp, Homo sapiens
taaggacctgcaaacagcctctaggagctgacagcaaccctaattaacagccaccaagacagggacctcagtccttccaccacaaggaactgaattctgccagcaacctgcatgactttagaagtggattcttccttagtcaagtctccagaccagaatgcagctcagctcaactcaagcatgttgtacttggactttggacctacagaaccatgagataatgaatgaatgaatgaatgaatgaatgaatgttactttcagctgataaatttacggtaatctattatgcggcaatagaaaaccaatatagattctaataaaaagatattttaaaaatc

SEQ ID NO: 258747 - DNA, 132 bp, Homo sapiens
ggtgaatgggtttgggctgtcatcttcagaaactgatttcatctagaacagtttgtgacgggcagatgtggaataaaaccactggatgcatcaggcgtcactgccaagggtgcaaggggctgctccatgctg

SEQ ID NO: 258748 - DNA, 452 bp, Homo sapiens
aatcccacacacttaatagaaatttacctcacagttctggaggctgcaagtccaagatcaaagtaccagcaaggtagatttcatcttgaggccacttctcttggcttctaggcagccaccatctccctgcctgctcacatggccactgggagagaaggagagaaagagtgagctcccctgtttcctcttcttaggaggacactaatactatgggatcagggaatcttctttctttctttctttctttcttctttttttttgagatggagtctcgctctgtctcccaggctggagtgcagtggtgcgatctcggctcaatgccagctccacctcccgggttcacaccattctcctgcctcagcctcccgagtagctgggactacaggtacctgctaccacgcccggctaattttttgtatttttagtagagatggggtttcaccgtgttagcc

SEQ ID NO: 258749 - DNA, 346 bp, Homo sapiens
gcaatagaagagatcaagccctggacaggacattggattggatgaggccattttggcccagggactgtatgatttttagggtcagagggacccatgctgaagagtgtagatggccaagtctctggctactgactgcatccaagttcataaccacctgcatctgacgacagaagtactgaccgcaaagaagagctcaacatctgcacacatcccactgtaaggaagtagactaaaagacatgcatttaaccagtaaaacttttcagggaccccgtaaaaccattatttttctgttgggctgtcctaactcagaagaaacaataaagccacagcatattcaagatcat

SEQ ID NO: 258750 - DNA, 353 bp, Homo sapiens
tttttagctggtgataaatgaagtagctgaaattgcaacatatgtatttggcttacctatgacacaaatctgatagaagcattttctagtgactagatgagaggatgtgacaaaaaatcagatggactgtctgagatcccctacttccaaaacatacctcaggtttaacatgtgtgtaggatgagagcctggagagagagaggttggaagtacacttaatagaataagctgaattgtcagaggggaaaataaaaatgcgttgaaaatgtaaaagcactgtcaaaactagctatattgaaatttagatcatggttctatgaacatgtgtaaaaactgcaaagtttcccaagatt

SEQ ID NO: 258751 - DNA, 478 bp, Homo sapiens
tctcgaccacccccagctcacacacccctgcagtgggacatttcccagaataagggagcagagctcgcgagctggagtgacagtgccctccactgccagggtggctctcaagcccagggacggcagtgggccctgagatgcggccccttctgaattaattcttggctatctgtgccagaccctgcttaggagcccaaagctggggagaaagcatgggggttccaggacttgcccatcctgtggaaaggtgggtgtggtgccttcagccccactcttggtgtggagggcactgcaaggcactgaagagttggggctccagaccccactcagggagcctccagatgagtgttctagaaacctgcttccactccagctaagcttgttttcatttacatattcattatgtcatcacttatggtttgctcaaaccctttctgaatgagatggacctaatttaataaaaattacactgacaagt

SEQ ID NO: 258752 - DNA, 110 bp, Homo sapiens
ttaaagagacagagaaagagactcagagattgagactgagagcaagacagagagagatactcacagggaagaggggaagaggaaaacgagaaagggaggagagtaacgga

SEQ ID NO: 258753 - DNA, 685 bp, Homo sapiens
gagagagagaactgcaccccgactcccagaggggctactggacattctcagtgggacgaggatagggaaccaaggaacactatatgcatggaagagctcagaaatacactctcggcacggcgggaccccgagtctctgacaaagtaccgggcagggacagggcgggggtcagggagcctgaacccacactgcctctcctgcaagggggctcaggagtccatagccttttggagggagttgggtctctctgggagtgggggcagaggctggattctgcccacaggagacggccagacagctattgtactgctggctccaagcccaagggtccacccttagcaaggcattcattcctcagtgtgcagaacacccctcttgagggtgaagacagaaatcacaccctaccctggaaggaggctgagcccagagctttgagcattcctgctgccggggagctttatacagccccaccctccaatacctcgccctctagggactcctccctcttcctagcccttgccttccctggggggctgccctcagcccagcctgctcaggagttcccccacgctatcccctaagcctggagaggaatttcctgtttgcttgtcttgctcagggtggtggctgaccacagagaacagtgcaatagcatccagtggaatgagtgaatgagtaccgtgtc

SEQ ID NO: 258754 - DNA, 484 bp, Homo sapiens
cagggccacacagaggaagtgaccaggatttgagcctgagtctttccagccttctgcaccatgatgccgtaagggaaaactttatatatgtgaaaacagctccacggccccctcagtgtcttctcttccccacagaaaacatctcctaggcctcagggtttcgttttgtgttctgccaccatcctggcccctatcctcttgacaggctctaatttgttactgtctctcttaaataaatagcttgcagacttattccagctgtcttctgaccagtgcagaataggaatgcactctcacctcctttattctaggggctctgtttttgctaataacacctaagatgatgtggcccttggaccattcacattatgctgatggctctctcatacttaatgatcttcaatctgcaagaataacaagagcctttgtgctctgaacagctcgtagcagtcattgcagatcttcatttcaggtaatagaacct

SEQ ID NO: 258755 - DNA, 991 bp, Homo sapiens
ggtcagagtggaaatgtaaaaatactaattagagaataatgtgaatacaacaggaatcctgttggtattctatttatattgtaagcagcagttcaattgttttgtaaaagtaatttcaattttaatcactgaactaaagaaatgggcaaggctgacttccgtaatataggttctacctaaccatctctaacaccgctgtcaaggaggaccagtgttaaggtacattactaacaaccacacaaatttttaaaagaaaagaacactcttagcagcctatggtactttgaaatgaaatattgcctctcattctcacttgtgttgccattccaaaagtatgaatttgctgaggtttatattctgggtattatataaccattggttctgtttggcataaccctattaaatggtgcgcagagctgaattacctacagaaactttctggtttaattagcataaattggtataaatattagtgagcccatacttctgtgatataattaaaccaacttaatgattctcacataaggtgtcaatttattttactaatgcattcataatctatgctttgtagcaacatttttcaaatgtttaaaatgctaaatcttctcaattttccaatcttttcttgaatctattagatacctatagtgtagttactgaatagctgggaaacaaatacacctagttagaaatggcactgctttataaaaggcactagagaaaagacgagactattcctatatttaaatgctgctggcaagtgaattcctttgtatataaatgaaagataccattcattaaaatgaaagacttgttttaagtgtgattcttacatttcattcatttatgatagagtaaatggctttataattactttaaaatttaactcactagtacattaaatctgttcattgcaagattagaatcaactgtgaggggaactaatttaaacaagcccttccttagtcttattgagtctcatatttgctga

SEQ ID NO: 258756 - DNA, 405 bp, Homo sapiens
aaccaatcaattatactggaactctatatattgatacatatctttactagtaaaacaaacagggtctgatatggtttggctctgtgtcccactcaaatctcatctcgtgttgagggagggacctggtgagaggtgattggatcatgggggcagcttcccccatgccgttctcatgatagtgagtgagtaacgctgtcaatgtcacagagatggttccttagagtttctccaggcccctctctacatgtggaggaatctaatcacagttgtcaactgaggcctggcctatgtgggcagatcctcgaatgttttttcttttctgaatattactttctttcaaatgctaataagggttaggcccaaagcattttgttgtgcccttcaaataaagaaaaactacaatgc

SEQ ID NO: 258757 - DNA, 389 bp, Homo sapiens
gataaattaggaaatatatgtggagggatgatggttttggatatgtagaacttgaagctctgtgatggagatctctttggatcaagtagaaatgtgttggagctcagaggtaaaggctaaaatattaatttgggagtaagttacattaagtgaaaggtgaagctatggggaagttgagaccccccaagggagaagtggttgaagatagaaacttaaaaaaaaatgcctttatttaaactttttcttgtattgatccagtgatatatgtaagcatggagcatggaattttttgaataaatcccacttgattaactattgttagctcatgtctcctacaaataaaatgaaaaggaaatcattcttcgtgtttgaatgccaatgatttggcc

SEQ ID NO: 258758 - DNA, 351 bp, Homo sapiens
tttttttttcatttggccttagctaggttcctgaattatttctttctttctcctaaataagtaataatccccctttccattgtgctcttattgctcttactttgtggagtgctttacaatttccaaagcatttttacaaatattattttatttgattcttgcaagaaaggatatatgccttctttgaaggcaagaaggacacatgctattatccgtattttacatttttacatatatttgtatggaaacttagaaagacttgcccaagggcacacagagtcctttctctgtccctttataaactgtgctgtcttatatgtgatttaatatcatcagcctctacagatctat

SEQ ID NO: 258759 - DNA, 421 bp, Homo sapiens
ccattctcttgtgtttctgtttctcctcggctgtcagcacttctctgtctcattatgtctgagctctcaccaacaggaacccacccaaaggcctgtctacatgttgcctggttgtcttatttaaagctgtattttaatttttaaaaatacattttttgtggggtgtgatggctaatgcctgtaatcccagcactttgggaggccgaggtgggtggatcacttgaggtcaggggttcgagaacagcctggccaacatggcaaaaccccatctctactaaaaatagaaaaattagccaggtatggtgacgcagcctgtaatcccagctgctcgggaggctgaggcaggagaattgcttgaacttgggaggcggggcccctgcactccagcctgggtgacggagtgagactgtgtctcaaaaaa

SEQ ID NO: 258760 - DNA, 374 bp, Homo sapiens
actggagaagtatgaggaaaatcaggagtgtatagttaaggaagccaaaggaagagagagtttgaaaaagaagggagtgttttatggttctgaattcagctaagagttcaagtaaaatacaaaaagattgtttaaattaaaaaagccattggattttgtaactaaaaagcatcagtggccttttagaagcctttttggtagtctggtagtttcaggagttcagtaaatttggttaaagagttaagtgggaggtgattggataggatcatgggaggtgggaggtcatactttcatgcattctggctacaaagaagagactgaagatggtatgtgaaggtggtattgaaatgggaaaagttcccttgtcccccttg

SEQ ID NO: 258761 - DNA, 281 bp, Homo sapiens
ggaggagatcctgggaagaagcattgcctccacaaccctttcaaccaggcaagggatttgtagagaagcttctgggatctctgaagtgtctacagtggttcccatcttaatggaaagtgggtgctcccttttcctgtgaagttatggggagagtggaacacagacaactcacatcgggaggtgcagccccaaaggaccacagcccctaggctggacaactccttcagtttgcccagccccatttgttggggctcctgttcttcctgggttacatgcccaag

SEQ ID NO: 258762 - DNA, 434 bp, Homo sapiens
caggcaccatctgccggtgcagggtcagagagacgcacgaggacttgaaggagcctctcaagaaggtgatgtgcaccacgtccctagcagaggagcagagagggctgagtaacccagcagcgccccctgccacctccccgtggggctctccctctgcctctggctccgggctgcccattggtgcggacactggacactgaactccctgttttgggattcatttggcagggtctctcatagtgtccccagtgtgtccggcaagcaccccagcaattccacacccagggacgtactccatggaggcagggcctcagctcacagagctgggggacagtccggggccctggcacttttgctcttgtcccctgcctccatagaaacatgaaaacccagattttacaactgcgttggtataaagatgaatatgacccagg

SEQ ID NO: 258763 - DNA, 673 bp, Homo sapiens
tgtagtacgtgctgcataacatacgtgtgcatgtcatcttatgggctagttttcatacagtcctctcttacacaaaaaagctgtatggaggtataattcacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttcca

SEQ ID NO: 258764 - DNA, 455 bp, Homo sapiens
ggtgctggttctcgggcagccagctgacccccggcctctatgcccaggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagtaactctgaaaaaaaaatgt

SEQ ID NO: 258765 - DNA, 568 bp, Homo sapiens
gccaccatgtctccacagctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagtaactctgaaaaaaaaatgt

SEQ ID NO: 258766 - DNA, 483 bp, Homo sapiens
taaatttctcttcaataatcttactttgctgtaactttattttataataacttaaattttaaaaaactttttggttcttttgtagtaacacttagcttaaaacacaaacacattgaacagatgtagaaagatattatctttataatctttataagcttttttctattttaaaagttctttcttttttcatttatacctttttttgttgttgttaaaaacaaagacataaacttacacattagcctaggcctactcagggtcaagatcatcaagatgccactgggcagtaggaatctatgggccaccatcatatatgccatcccttgtttactgaaatgtcattatgcagtacatagctatattgcaaaaccattttaaataatgtgcatttgtagctaggtgttatctacaattagacgataatcctgaaggatcaactatataaatacgaaagacaagttctcaaaatagctatagtatttt

SEQ ID NO: 258767 - DNA, 426 bp, Homo sapiens
tctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaa

SEQ ID NO: 258768 - DNA, 660 bp, Homo sapiens
cagaactgagggttcctcccccttttagaccatgtacggtaacttcatgacgttgccatggcatttgtaaactgtcatggcgatggtgggagtcttttagcatgctgatgcattataattagcgtataatgagcagtgaggacgaccagaggtcactttcatcaacatcttggttttggtgggatttggccgtcttctttactgaaacctgttttatcagcaaggtctttatgacctgtatcttgtgtcgacctcctgtctcatcttgtgactaagaatgtcttaacctcctgggaatgcagcccagtaggtctcagccttattttacccagcccctatttaagacggagtcattctggttcaaacacctctgacaatagtaatcataacccaaacgtggattccctgctccataagcccttgcctccccctgtatcctcaatttgctgtcacctctgcccctagtgtagtggtggtggtggtggtaagggattttggtaggatctcatctcactgctacattaaaaacaaaaaaatatatatatttctacttgggaggctgaggcagtagagtggcatgaacctgggaggtggagcttgcagtgagccaagatcgcgccactgcactccagcctgggcgacagagcaagactccatctc

SEQ ID NO: 258769 - DNA, 307 bp, Homo sapiens
gaggctgcatggtagggtggaaaaaatgtgaaatttggagccggaaggaactgagctggaattttagctctgccacacacctagttgtataatcttgagcaagtcactttctgtttcttcaccttaaagggaaatcataacgaccattttgatgggacaataatacatatataagtatgcatgcatgtatatatatcagcaccatatataattcagtgaatggtaactactattatgaatagaattacctaacttatttgttaacaatgtaaataaactgaacaaacataaaatgtcaatttttaaa

SEQ ID NO: 258770 - DNA, 284 bp, Homo sapiens
cagttgaaatgggtattgagagagttaattgtatagtacctatcacagttatttctcattttgtactggtcccagctaaggtggagagattagtctgttatgtatgaaatgaagtaccagttgagccgaaaatctgaaatccgaaatactcccaaatctgaaactttttgagcaccaacataatgctcaagggaagtactcatcatgcatttcagattttagattttcagcttaaggatgcccaactggttaagtatataatgcaaatatttcaaaatgtgaaa

SEQ ID NO: 258771 - DNA, 518 bp, Homo sapiens
tttttttttacaattttgaagtgggcaaacatatattcaccataaaaattgaggaagtctttaaacttacaaagagctaaaataagtgcaactcggaactgcattctgcaattcaaaggtacgtacatgtaaatacattcatacacaacaggaaaaaatacaaacagaaaacaaaccatgaagtgctttaatggtgttctctcaaaaacttacaggttaacctttcataaaaaaagggtggggggtaaagaaaaatgtttaaggattacttgaagcaaactacacagataatactaaaatccagcagattcatatgaagcaagagaaagaaaacctatgttcaaaagacacaaactatgcaacattctcattaaacaggcaagtatgaacaatccaatgaaacatgcgataaagcagatgatggtccattgaaaaagttcagtgcaggatatactaatcggaaaaaagcaaattaacggcagactaaggaattggctttatgaaatattgagataatg

SEQ ID NO: 258772 - DNA, 433 bp, Homo sapiens
acacaggaaccaggaagcaagagactctccttcaatgtctgtagcgccctctactgacaaagcctcagcatcacttgcaaaggaaaatatttaaagggcccagaactgttatttacagagccatcaaaaaggatgaatttggaagaggcaataaattggcaatgggcacataaggtcatacacacaatgacacttattgcaggatttttttgtaatgtttaagccctagaaataacttgggtgttctcaataagagaatgattgactaaaatcatggtatacccatcccactggatattgtggcagctacttaaaatatatgttagagccatatcaagtgctctagaggggcttctgtgagctttggcaaaatgaaaccagaaatttcagaggaaagcctgggtgacagggggagaccctatctcaaaaaaat

SEQ ID NO: 258773 - DNA, 364 bp, Homo sapiens
aagaagcgccggcccgagctccgcgcggagggatctactacgagtcactggccccgtccgcatccttctccagcggccttaactcgatcagggctgcagcggctcgctggcttgaccagtgcagaaggggcgtggaggtgagcggggtggggtaggactctgaacttcaagcactggagtttgccgggatcgtgaacttgcagggagaggcggtcctcatccagtgaggtctgtatcgccacctacacccacacatccacacactgctttgctagctagaggaatgctctggagtaggaccagtgctgtcaaagaaggaaagtgggccaaggcgccaaagtccattaaaaaggaatagagccat

SEQ ID NO: 258774 - DNA, 286 bp, Homo sapiens
cttggctgatggcagcacacaaccatcccctcagtaggtaccaatactagccaatctggacccatgtgttcgctgctctctgaatctctcccgtgtgtatacaaagagacccccactggaccgtgaacccctggccagagacaagacttctgtcccattcctagggggtgcagagcactcttcttggcattgtgagcgatccaaaaggagacatgtccctgtccttgagctgcttgcaatctagttggtgctcctagttggtgcaccgggagacaaggcaaatgca

SEQ ID NO: 258775 - DNA, 207 bp, Homo sapiens
tgctgttcccctgggtgcagcgtgtccctgtgctcacgctctcagtccctctttaccttaggaagggacaggccttttcccagccgcggtggatggctggattggcgctttcatctcggttactctgtgtgtggtgtcctggaacggttgtgtgacagccctctcccctcaagagataagattaaaaaggaggatagtctgtaatca

SEQ ID NO: 258776 - DNA, 288 bp, Homo sapiens
cgtctggtcgtcgggttgaaggcgtctcttgctttaccgaactttaactgatcgtagtctcatttatttccttccgacctagagcacctcttatccagaagccaccacctgctgttgctcagtctgcccaggagtatagacttgtcggccaagcttcccctggcaacctgggagttgaagcaaataagaaaatttggaagcacctgctgaaggctgtttagtacccagggctgttgggagatttgccccaataatataaaagtagcctcctgggctttgtgcagagga

SEQ ID NO: 258777 - DNA, 487 bp, Homo sapiens
cacaccccgctgatttttttttttttttttttgtaaagacaggttcttgctgtgttggccaggctggtcttaagcagtcctcctgcctcagcctcctaaagtgctgggattaccggcatgagccactgggccctgcctggctgttctgttttgtatcaattaatgcagtgtgttttgtggccaatgtcctgggtgtctttgtagcttatggtgcacacggactcccattaccctaaaacacaagaaatcttgtgaacagccaacaagacctggcctcttccctccagaatgaattcacagcctcatcaggagtacatatgaaacagctagctcacaataagcagccgtgcatgactccatgctaaactgtgtggtgcaaataataaaagacacagtcatcaaaggagtcaaggacaatggtgtagaaaggtggggtatgactgtgcttctgactctaaggaagaagaaaggacattgcagaggaacg

SEQ ID NO: 258778 - DNA, 513 bp, Homo sapiens
ctcccatcttttctgattagcttcaggagagaaagaccttcaccagtaaacctggctagggattctggggatctctcagattttttctatggatgcacctgctccattcctcttgttccctcttaggggtaattcttaagattttgtgccttctctcaattctgaaaagacaagcctggtgccgagaaactccttttattttttctatggtcctgatgtgtttgaggttgagcatcgtcacctaatccaacagccaagccagctactgagctctgcatctgctgttgagatatgcatgctgtctgtggaggctcacatgtactgtgtgggataccatgcatgggtaagcatgggctgttggctgtggggatgatggtatgagaggtcctaggagaatgcattgacttgttaggtgagtcttcaagttttacaataggccttttgatggagtctgtaagctggttatcaggatctgttggtagctgttgaaagatacccatatcctcctggaaa

SEQ ID NO: 258779 - DNA, 465 bp, Homo sapiens
tggctaatttttaaattttgtttagagacaaagtcttcctatattgctcaggctagtctcaaactcatggattcaagcattcctcccgcctcggcctctcaaagtgatgggatttcaggatgagcctctgtgcccagcctgaactcctatcttatagcatagttcacatatacagctatgtgtgagtctgcatctttatctgcatctatatctgatgcgtctttcttagctccgttattcaatccatgatccttaagtgcatggtctggctaatatttatccttatattcatatagctcctagcacaccgtgtgactcataaaaacactcaaatatctgtagcatggattaataaatatgcttaagggttgtcatcaattgttagaggtgaaattaatttgttacttgcagttgtatgtaagaataagagaaacaacttgtcattttgatatcatgtagatgaaa

SEQ ID NO: 258780 - DNA, 304 bp, Homo sapiens
ttcttttttggggatttaaaaaatatttttatttgtaattgacacaaaaaaattgtacacatttatggggtacagtgtgatgtttccctctacacatactttgtataatgataaaaaatgactaaaaaaggtaatgtagataaaatgtttgatgcaaaaataacattaatattatatgaaaatatgtacattgctaaaaagtaaaagcactgatactcatacatttagatgggtcaaataatgcagcagaaaattcacagacaggctaaagaaatgtttgaaatgtgctcaagatcaataataa

SEQ ID NO: 258781 - DNA, 289 bp, Homo sapiens
caatgattcattcaatatttattaactacctactgtgggccagtgtacactccggacttgagtctgtagaggggcactcttattccaatcagtagaataaacgtggcgtgagctttacagtgttcctctgggtaaggcaagtaatgcttaagtagttgtacttttaatctagtgctaattaatggcctcttaaaagtgcagtgttgggtcaaatggtatttctagttctagatccctgaggaatcgccacactgacttccacaatggttgaactagtttacagtcccac

SEQ ID NO: 258782 - DNA, 420 bp, Homo sapiens
atactatgcttattcctgtgctttcattaataccctcatctggtacatgctttctatccagttctcacctgtttttccaaggtcagtttaaggcagatttgtaaagtcttctctaatctctaatctaaatctgacctcattttgtaaaaattcagtttattaatgtttattattagacactaagttctttatgtgtattaacttatttaaccttcactatttttaagtaattgcacatagtctgaatctgttcattcagaaattacatattgagcaaatactgtggatcagtggcagtttctgggttctcagtgacaaatttgtagactcttcatatctttatggaataagtggaccactggtgttaccaacctagatgatttcaagaaaagtggcaattaaatgcttcatttgtatttt

SEQ ID NO: 258783 - DNA, 472 bp, Homo sapiens
ttgtatttttatacctaggaaatatttttcctttttgtaagaatgataatgcagatgaactgttattcaacctggcaccaccatctgtactcaaaaagtcattatttccttacattttatagtttttttgtttaagagacagggacttgctgtgttgcccaggctggagtacactggcatgatcttggctcactgcagctcattcctgggcccaagctattctcccacctcagcctcccaagttgctaggactatctgaagctactatgcccagcttaatctacttttttttgtagaggcagagtcttcttgcctaggctggtcttagactcctggcttcaagcaatcttcgcacctcagcctcccaaactgttgggattatgggcttgaaccactgagccactgtgcccagcctatttttatagtttttttgagtctctgttgcccaggcgacagtgtgagactccgtctc

SEQ ID NO: 258784 - DNA, 888 bp, Homo sapiens
tgcttacgtcttatatttaatattttcacttcactgaatctgatcatcctagatctccttggtgtgaagcaggtggcttaaggttatctctttcactatttttttttttttttttttttactaaataaatcagtcaagagtattctgagtgggaaggctaaacaattagcatattgatgtgatgaaacacaagctctgttaccacaattgtctagtagagtggttcattcctcaagtaagtttatgcttttactattaaacttcactaaataaatagatgttgggtgccctcccaattaatattacaattatttttcttctatgagtgtttttatgtcctaagaacataaaaactaatatttaataagttgcattacatttggtaacaggaataataacaacaatggttaatagtcagcttatgttcttttctcacagagcttgcgtatacattttggttttcttctaatctgggataaaccaacatcttcaacaagcttaaaattttctagtatagaaagaacaatgagacacttttacttatattaaaatatgttgaagaagaaatacaaaataatcaaacacaagcttaatggggaagaaaacttttttcatacaatatgttttgaactggtcaagaataaaatactactgtttgtattttgtttccatggaaaagatgcattctctaatgtttagatcaaaatttacctaagagaaaaatagaacaattttccaaacatcagaaatgcattattatttcgatatattggtttagcaaaacataatattgacatatttttattattaataattaacatatcaatatatttttatcataattaacatattaatttttaatataaatttaacattaacataatatta

SEQ ID NO: 258785 - DNA, 871 bp, Homo sapiens
gaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccct

SEQ ID NO: 258786 - DNA, 376 bp, Homo sapiens
ggatcccccactttccacagtagcagagtaggttggtgacgtgggggaggctgcaccgccttctgttgacgtggttggaggctttgtgtctggcaccgccaccaccgatggccaggcctgtgcctctgccggtgccagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccct

SEQ ID NO: 258787 - DNA, 730 bp, Homo sapiens
ggatcccccactttccacagtagcagagtaggttggtgacgtgggggaggctgcaccgccttctgttgacgtggttggaggctttgtgtctggcaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggattttttttttttttaaaatactttagggactgttgtaatttctcatatggtgctggaaatggttgggctttgtaacatttgaagtgtttccatggtagcgtgagcattaggtgacgtggctagcggaggactacccttggctcaactgacttcctgttgtaacacactttccttacggagcctggctgtttcacagtaatttcatgaatttacccacacaggtgtgatcctc

SEQ ID NO: 258788 - DNA, 227 bp, Homo sapiens
gaaaaaaaaaatgtctgcaaacttcccaagtttggagaaagatatggacagtagaaaaggtaagcaagccaggcacagtagcatgtgcctgtagtcccagctacttagagggctgaggcaggaggatggcttgagctcaggaatttgaggctgtggagcagcttcgattgtgcgtgtgaatagccagtgcactgcagcctgggcaacataactagactgtctctcaa

SEQ ID NO: 258789 - DNA, 631 bp, Homo sapiens
ctcagcctcccaaagtgctgggattacaggcatgagccactgcacctggccctagggaaaaacatttttaatttcagtatacagatggagaaattaggctcaaggaagccaagcaaattatgcaaaatcagcttgtttgtaagagatggggcctgattctgctttacttcaaagcccacatattgttaatcaccattctttccatattgtccattatattgttagtttttttttttttttttctttttgaggcagagtctcgctctgtcacccagactggagtgccatggtgcgatcttggctcactgcaagctccgcctcccaggttcaccccattctcctgcctcagcctcctgagtagctgggactacaggtgtccaccaccacgcccggctaattttttgtatttttagtagagacggggtttcactgcattagccaggatggtatcaatctcctgacctcgtgatctgcctaccttggcctcccaaagtgctgaaattacaggtgtgagccaccgtgcccggcaggttttttttttttttttgaaagaaggcataaagtgcttctgctcatcagagcggctgggatctcaggatagtgggaccattctcccacaagagatttttgt

SEQ ID NO: 258790 - DNA, 294 bp, Homo sapiens
ggcccagattgccttattccacctatcatggaataaaaaagaaatccagaaaaaagaaagaggctatgctgtgatggctgacagactctgaggaaattgcaaatacactgaggaccttggagagcagcctcagatgatcacttctgcacctgtcttcttggagaacaggaattttctgatctttgaaaaactacagattcatcgtccaagaaaacccagctaatttgttttcaatcagtttcaaaaaggcatattttcctgtaaactggcaatgtacctgggaagctaggacat

SEQ ID NO: 258791 - DNA, 471 bp, Homo sapiens
agatttcagatctgtatttctttgcaatattcttttcagtctcccggtcctccttaaactttactttccctctaggcatgtgagctcccttaaataatcaggcccagaaaagcatttaacatgtggcaacagtcacatctcactccctcttgagctaaatcactatctctccaagccacttgctttgcaggctctagactaactgatcccaagtagccataaaatgccatataccctatagttccacaatgtatagccaattgctaactaatgttatttctgtgaaccaatgagaattcttgacaaaaaaattttgtaattgttgcttcccctgattcatcttttttttctttaaacacttgagcatctgttttgttctccagagcactcccaaggcaatttggaagtgtttcctgggctgcagtccttaacctttgtgcttgaataaactctcttaaaatagactttgaa

SEQ ID NO: 258792 - DNA, 592 bp, Homo sapiens
aaacatttggctcatggttctggaggctggaaagtccaaggctagggcttcacttagtgagggtcttcttgtggtatcatcccatggtgaaaggcagaagggcacaagagtatccacaagagagcaagaggggtttgaatttgcttttataacaaacccattcttcagataactaatgcactcccctgataatgacattaatccactcacaagggcagaatcatcataatctagttatctcttaaaggtctcacctctcaaaactgttgcattggggatgaaattttcaacacaagatctttgggagacctattcaagccatagcaccctccaacaacaaaatgttaataaacactacatacacacacatatatttttcaactggagaattgaaaaaaaaagatatctgacttttattttacattgcttcaattatgcagtgggacattcagatccttgatggtcatttgctgttgttactgttttctcaaactatcttacgttttgtaaattgtctactaatattgtctatttctttattgtgtatgtttttgtttaattaataaaattatcttattttctgccatagttg

SEQ ID NO: 258793 - DNA, 467 bp, Homo sapiens
gcaggaaccaaggactagacattttcaaaatggcagctccatcttcccttctctgccagtcatgtgtatggtaaggagcagacaagatggctccaatcaactggaaagtccatttgcataagaagattaagatgggacgaccagtcttctcctcttctctatgtaaatgtcatgcctgattgaaccaatctatgagtcctatctaaatcagacactgcctcctcagactggactataaaacttggggcatttgccactagctggtctttttccgcttggagacaccttcctttgttgaggaagctgtttccctttctcttctacctattaaacctccactcctaaactcctcatgtgtgtccatgttctaaattttcctggtatgtgacaacaaacgccgggtttataccacttcacaagctcactgcacacattcagtttgacaattcaaggttcccctttaatta

SEQ ID NO: 258794 - DNA, 399 bp, Homo sapiens
taagcagggtggttatttgttctgcaatcaaattgcctggattcaatttccaactcaccatagactaattttgtgaccttgattaacttaactgtgctttgactttctaacctgtaaaagtcataattttaccttatgtctggataacaaattgaatagcagtgggacaattattgtacctagctcatagcaatgtgaacattcatgagataattcatgaaaaggacttaatacataactgatacacaataaacactcaacacatgtttaactattataatttttattggagtagataactgcattttttaacctttttccttgatgccaatatttttgtacttttagtatgttacttaactctgattgtaggtaggaattactctatcttaaactaaa

SEQ ID NO: 258795 - DNA, 443 bp, Homo sapiens
tctcgcgtgtagagttgaggttaggagcatggactctggattcatcctgcctggatttgaatcccagctcccccacttacaagctgtgtaaccctggccgagttccttaacctctctctgcttcagtttctcacctgtaaaatgggaataaccatagaaccttcctaattgggctgtagttaagattaggtgagttaataaaagtaaacttaaggcattgcctgccatacagtaatggcagttgacatgacatcaatgactatgatgatgatgatgatggtgaagaaaatgtcctccccataaacaaaacaaaattgtacacacacaaatatatattacctctatcttgtattctactgaaaattaacatctctttatgcttactagatagatagttatacactcgttatcttcaatactaataaagttcctctcttgtatgt

SEQ ID NO: 258796 - DNA, 144 bp, Homo sapiens
tctgtccctacagagatatagcctgagttctgccaggagaggacccatattgtttcctttaaacaacagcttattcattattgataagatccaaggacatctccatcatccactaccctaatttaataaaatatcttgttcact

SEQ ID NO: 258797 - DNA, 782 bp, Homo sapiens
ctttgggtaaggcatggggtgatggcccatgctctccccatgctcccattccctgacaaactggagggggctctgccacctatcaggcccacccatggtggtgggtcagacaacttggcttgttggaccggaaatgtgtgatttaaacctcacaacaccagacaaatataagatcctcagtgatggtcattggaagccattatccttaatgcagtaatgtatgccttgccctgaataaaatgggattttttttttgcttcccaattaactgctgttcttcctgaaatccctgttaccatggaaaacagagagttagctgtactgtcaattctaggtcacggtgtttgaagatacctaattcaatgggtaactaaaaatggggcttctctttctactaattaataatgtatcctgatcagagccttacaactgtagcaggttaaactgaaaacagattttcactgtttcctacaagaaaatgctctcagtctaccattggtcccaagtgggttctctgctacagggaagaaaggtgtctgttctcttctactcttcttacaagaaggggcacgacagagagcttttgtgcgacttccctgataaggtgaccagcctttattcagccctggaaacagttacagttcattcatgcctcattaatattacagcttgtttgacttgggtatttgtgtaataactatatttaactctaggatattttccttcatgtccctgttttcccctaacagtttatacaggattttggcttcttctaaactgac

SEQ ID NO: 258798 - DNA, 226 bp, Homo sapiens
ttttttttgaaaatacactaccccattttggaggacaaagtttattgctcaccctggcaccagcaggccacacaaggaatgccggctatctttcctccagctacctgcctcaagactggggatggaggatggtagctgttacataaaataccaaattttaccagcccttttcttcatcaagcacttccctgaaggctgcaactatttgactaaattccagagctcc

SEQ ID NO: 258799 - DNA, 627 bp, Homo sapiens
gttgactggggtgctcttgtgttaaaaactatcgtggtaacattttttgttttgtcctctaaacttgatttatctgcaaatctacaagcgttttaattatgtaaatagatatctgtgcgggcaaaacactttttgctcacatgatcttgagaaggaacttagattctggtgtcttaaaacgtggcaccttttttatgtccttggggcttttgagtcaccatataaatgaggtctctcatgttcgtatgccagggagatcaaccacctctgattttaaataaaacactgcaaagaaagcttccgggaggaatgagagcatgccccaaatcacgactctgtaattagtctttgtgcagagcggacagaaatttcgtcccaaagccaccgtccttgctctggttcctttctctgtaagcatgtcacacgaaccacactcctgcgccatgcatcgcaatttaaagctttccttgtaaagtttccccagcttgattgcttatggaaagagcagctccggttcccaattcgtttaatacatcctgtccgagcgcgttttattaccgaatgttacccacgttgtgataacaaggggacgctgtgtcctcccccggtgaactcactccctgtccc

SEQ ID NO: 258800 - DNA, 196 bp, Homo sapiens
ttttgattaattacgaatgtaaacattttatatttagtatacccacccagataaaaggcactgacaatttttacatagaccagcaggtaagtgacattcataggtaagtgacagaacagaaaaacaggaactacaataatagaataaatgttgcacacttattagttacctgagactacaacttttaggaataatg

SEQ ID NO: 258801 - DNA, 586 bp, Homo sapiens
tagactaaagcgtgaaagccgagtatcgcgtgagagtccggaggcgctgaagggagggtcgcagcgccgtgactttcgctttactaggaatggaggcacattgttttcaaaataaagattacattatactagcaaagattagaaatgtgagcatatgatagtcttttttatggacttagagctaaaggtttgcaagtcacttttacttttctggtctcccaatccttgcggcgtttgtgaggtgggtgtggctctatgccccctttaactgtgagctaaataaagataaagcttagaatcgaaatggcagaccgggaatataaactatttttcttacttaatttctaacagggtgctttccctttggatagcgattggtagttacccgggacctctaagcctataataatagagacaaagtcaaaggaatccaactcttaaaaccctcacaccccccacacctgaaaaaccctgacagtcaccgtgctttttttaacagcagaacttctaaggttcttaattcattcaataagggttaacttttagtagcctgtgaagttttggcaatttgacttacgatacaata

SEQ ID NO: 258802 - DNA, 693 bp, Homo sapiens
ggcagatcaaagtatccttttccaggcaagttgcagttatgctttgggaaatagacacgtgatattcaagtgtcagagtggatattgaagaatccagggggaaataagggcagaaacacacctacagctgtagacaaatgccaaaaaggttctgccctttctttgcaattcaatctaaagcacaataccatgctatgtagagcagtgcttctcaaactttaacatacatatgcactacttggggatcatgtaaaacttcagattctgatttagaaggtctgggatggggctaggtttctgcatttctaacaaaatctcaagtgaaactgatactgctgaaccaaggctcacacttttattataacaaagatgtcccttacttaggtatgccagaaaaagtgtgggctttggaatcagttaatcaattgcactctctctataaagaggataggtggatctgtaggtgggtttccatcctcccaccctcttatacatgacctgctaaaaattctgcttggtagataatcttggtcccatctgttctgttgagagagttagaagaaactttggaattgatgaatattagtggtaaaggagactggcagatttcaaaggagaaagaaaacttcaccaggttggagagatgaaacaaagaatacgattttgcctacaatgccagaaacatgcacaggg

SEQ ID NO: 258803 - DNA, 212 bp, Homo sapiens
ggctaactcttacttgtccttcaagtcaggggtgctcccacaggacccagtacttcttggatctcagctcctgtcacacagtattgtgaccgctgagctgactgcttgtcagtctctccactagattggaagcccatgtgtcttactcatccgtcactcttctgtccgcccactcacacaggaggcgtcaataaaagacacattggatataa

SEQ ID NO: 258804 - DNA, 305 bp, Homo sapiens
cctctctttcaaaagtctgcgctcagagtgagattaatgcagcaaacagggttcggttgctgccttttagaaaggcttgcccacaatccacaagccagacagagccacttccacagggtcatgctcctccttcccaaaggggcttctgccttgtcctcttttcccgaatcataaggactattggagcaaaatgagaaagccagcttgcaggtaagagaaaatccaaaatattattctaatgattctttctcccctcaagccttctactaaataataataatgacatacagttgtggtcattgtta

SEQ ID NO: 258805 - DNA, 2130 bp, Homo sapiens
  misc_feature (602)..(602): n is a, c, g, or t
  misc_feature (611)..(611): n is a, c, g, or t
  misc_feature (1236)..(1236): n is a, c, g, or t
cattttctacaaaatgagaggttaatcaatgttaatttgagtttatagactgaacataactatgtttcacagattttgtttattctcctagaataagccttttgtcaagctctgtatttcagaaacactactctattatacttggcaaaacaaaacggcattcctgagagtgaaaccctagtaataaggatttacattatgaaattaagacaaaacaaatgtagctgttacggattttaaaagttaggtcactacatgagtctagtgggaagaagttatgagaaccaccagaatcatctagaaatttttataagagaacatgactaaaattagctaaaacttaggaattagattagaaaaacagatacatccattcatttgaattgcttctataagcaacagtgtttcttttctaaaatattaatacagtaatcatcactctcctaaagctctccttctgctaggaggaaaatatttcctcaccctactgatgttgggcttagtcatgtgatttcattcacattaattaagatgcagaattttatctagaaatattacatgacttagtctaacattaaaaattaggttgacaaaataatcantttacctangaatatctagttacttttaaattagagttaaagcattaaaataatgcatccagttttctgtattacatttgtttttccataagtacagataaaataatattaatgatatatcagatagttttaaaactaaacactggcaggattctattttattatataagtaaaagtttagaattcctttctccacaccagtaattttgcagaaaactaatcaggaatattctgaaaatatgttggcactcttatttctattaactgcatatggtttgggattcaacttttagaataagccacgatgcatgatgcattagattttaaccagctgacgacccttggctatgtgattgtaaaggagatggcaaaatatcattgaagatggccatgtaaaacatcaatgagataagattcactcttacccaagatttttctatctatatcagatttttctatacagcagcaggctattcctgagaatgtgtccttcacttttttactttcatttgatgcgggtaagtaaatgtattcaatgagtttcaagtgtgtgaagaaagtgatataaagtaagggaaaattatggcacaatggctgtaactcctggaaagtaatgaaaagacagaatgtctcnagcatttgactggaaatagaagagactgcatcctggtgaactgagttaatttcaaatatattactctatggttttctatcatgtgtactctcactggctatattaataaatgaaatagtgatgaatggttctgggaacttgtagtgaaacttattaatatttcaacattatcaccgagtatctatgtcaacacacatcaaaaatgcatgagaaatgactacctacactcactagttacacccattagaaaaatatctatgagaagtataaatgacacacataaatttgcaatgtgattataggtagaacatacagcaagaaaaaagctacaggaagatatcacgtggtgaagtatgtgaaacaaatgaaagcaaattaattcttgcaatcggtttggaatacactgtatgaccacattaaataccattagatttgaaattatgagttcttagaaattactaacactaaaaaaatttcaacataatttaaaagtaggaaaaataaatagccactatcaaactgtaagtggctcatcagttctatccatggtgtaattttggaatcccctacttaaaaaacaaaagtaaaaacaaaacctttagttttcaaaagtttgttctactttttaaattgatgaccaagaggtaataaattcacattagaatgaggcatggccgtttaaacaataaatcaacacttaacccaatagtttccaagttgttaggtaggcttaaaaaaaaaagtctgtttatacctatatcagaagacattcgatttagttggggggtgtctgtcaaattgattgtttagcattatgcgtagagtataaaatgtcaaccatagaaatggagacagaaatcactttcaaaatagcaacatctgtgtagtagcttt

SEQ ID NO: 258806 - DNA, 535 bp, Homo sapiens
aaagattaagttcatatgttttttttttacaatgtttttctttaaaaaataatacacagttggccctcctatatccatgggttttgcatctctggagtcaaccaactgtggattgaaaatactctgaaaaaaaaaaaaaaaaccacaatggatggttgtgtctttattgaacatgtataggcttgtttcttgtcattatcccctgaaaaatacagtctaacaattatttatatagaatttacattgtattaggaattataagtaatctagaaatgatttaagatacacaggaggatgtaagtaggttatatgcaaatactataccattttatataagggacttgagcatccatggatttttgtcctttggggatcctgcaaccaatcacccagggatactgagagatgactatatttagcctcagctatgctaggaaaacactttatacctcccccttcctctaagtcagagaactgtattatcttactgtatctaggagtcagacaattgtatcccataggtgaaattggatta

SEQ ID NO: 258807 - DNA, 368 bp, Homo sapiens
ctctcagaactctcttggtctgtcccttctgtggcctgggatgtctcaacccctattagtggaacttctccaggcagctccctgccacagagtcctgatcaaaccaaaattctgaatgcagagagagaagaaaattattccctgacttcagccttaggactgcttgtccaagcccttgtttcctgacccagtattgacccttccccaggatgattgatgggggaaatagccattctcttcagggggaaaccctacccccacccatagaggtgtggtccaatatataattgattgacataagcacattccctaaagtctgggttatttggtcttaaataaaagcacatgtgggatctcagcagctttgg

SEQ ID NO: 258808 - DNA, 312 bp, Homo sapiens
ggttattgtcaggttctgataccctgttttcctctgaccttggttcagccagtaatacccgctctggcttcttcacaagtacatacttaccacaagaatctctacattttcagttcagagtcctcacaggtcagcaaatttggaggcttaatggttttcttataagctttcccacactctttgccttggctcaaacctcaatgtagtatcatttatcataagttaactatgtgaccttcaaatttaaagcaggacctggcaatgcagccacactacaatggcaagagaagctgagagccttgcttttctcaa

SEQ ID NO: 258809 - DNA, 299 bp, Homo sapiens
  misc_feature (251)..(251): n is a, c, g, or t
cggcacgagggagcctgacagccacttgagtgaggtcgctgccactgacagccaccccgactcccaatagcaaagcagctgcgcaccgacaggctttctccacccactgccatctccacagccgggactgccaccacccaagcacgccgctggggggcgcctaaaaaaggtacctggggagttgtgaggggtgaggtacagtgatttgtaagcaggattgccaaaggagacatcacacatcagacaactgnagagtaccccaggagcagaatttctgaaaaacccatagaagtagtcca

SEQ ID NO: 258810 - DNA, 339 bp, Homo sapiens
cggcacgagggagcctgacagccacttgagtgaggtcgctgccactgacagccaccccgactcccaatagcaaagcagctgcgcaccgacaggctttctccacccactgccatctccacagccgggactgccaccacccaagcacgccgctggggggcgcctggggattgcccactctgccaaccacagcctgagccctgagcacaacataggggattgggttgtctgagggtaggaccacaccaccaagcaaagcctctcccagtgcctgagcacactgcccaggggcctggggatccatggccctgtcccacccgtagctccgcgtatgctcctgca

SEQ ID NO: 258811 - DNA, 351 bp, Homo sapiens
aatattaacagtctgtcttctctctgtggacagtggaccttatctatactccccaactccacattcctcaaagtttgttacaggcccagcgagttcctgcttacctccctagcatggctgcagggtcacaagaccaataagtttaggtggcaagacatgtttctctcaagatataagaaatgtaatgctgtctttgtttcttgcttctgtaacttgcttcccgcctcacgtagttcctgccttaagatgtttacaagtagaaaaagccctttgttcggggctcaaactttctggacctatgtccggctgagctggtgatcaccttaatttaataaactctcctgaaccttt

SEQ ID NO: 258812 - DNA, 471 bp, Homo sapiens
aatgggtgctgctgcacagtcatccccttgcacagacagggaggcatggagtgactgcccaaggtcaaacgcttctattatttccatgtttctgtgacaccaagttcagtgagccactacacatcagcccaaagaacactgcctgagtctcttgtgttcccggagaatgtgtaagctgctttggggacagcaccccccgcttttcaggcatggaccctggttgtcactgttttagtgaaacagaagggcttcaagctattagaatgccagaaaacagagcaaagccaccatagctggtgtgggagaggctccccggagccctggcaaccctgaggtggttgagaagactctgcagggctcatgggctggtggcccatggtctggaaggcaccgtgccaaatgccagcccacacggtgctttgtgagatattttccttagctgccaatatgtaaagattgggaggtcatgca

SEQ ID NO: 258813 - DNA, 979 bp, Homo sapiens
  misc_feature (256)..(257): n is a, c, g, or t
gcggacctgcagcctgtttcaaaataatgatctataccagttgacttagagtgatttccacgatgctctggtgaaaaagaaaagttagttttagagaagacgctcatgaattcgcggccgcgtcgacgggatatagacaggcttgagcacctccacctcacagaatttggactaaaattggggcaaaaaatatttttgttaaacaaaagagattttttttattttatattattttgaaacaggttcttgctctgtnncccagggtggagtgcagtagcacaaggtgcatcccgggatcaagccttcctcctgtctcagcctccccagtagctgagactgatacaggaggtagaaagaaattatttaggcagatagtgagggcaaatgagtcctcagcagagcttcctttctaacaaaaagcagcccaagaaattagttttctcctaacaaaaagtagcctgaaaaatctagctgcaaacataggtaagcaagctggaacattgcacaggggaatgctggcagctgtgtcaatagaaaagggtactgggggccaggcatgtccatcatggaagcttcatcttcctttttgttagcacgtgtacagtaagaaagaagtgggcaacatggcacagcttaggctgaaaacccgcctgcataataaaatactggggtgggggctgccagaaaatcgtgccccatgcaaatggcacacctggtcctaaccagctttttgtgccctacgtagatcagacacaactttccaaccagctcatctataaaaccttctgcatttcaccgtgggtcgacaacccatttttctgggacccctctctgtagcagagagctattttctttcttttgcctattaaacttcctgctgttaacctcactcttgtgtgtccatgtccttgatctctgtggctgtgagacaatgaacctcaggttttaccccagacaatgaggctgcttcaagactaca

SEQ ID NO: 258814 - DNA, 231 bp, Homo sapiens
aaccaagggacttggacttggactaagtgggtgggaagctggggaagggatgtaagcagagcagtgatatgattgtgtagaaggaccatgtggctgtagggagacaggctcagcatcaaagacagaaacaataaatcatggtggcatgggctagaatggtggccatggaggaagagagaagtgctcaaatgttgctgaatgaatagtgaataaatgaacttgctcaatgat

SEQ ID NO: 258815 - DNA, 829 bp, Homo sapiens
actgtctaatgaaacataatataaacaaaaaatgctggccatcctaatattttgaaattttctagcagtcacgttaaaaaaagaaaaatcaggcaaaattgattttaataacattttatttacttaaacacgtccaaaatattattatcataccaatatgagcattaagtgtatattattcattcttttttcttaccaagtctttgaaacctggtgtatattttacattattacagtacagcatatctcaattggataagccaaatgttcaatagccacatgtagttaattactggctaccctcttggacagtgtaacattagagtgtcaaattataatgacttctctatctaaaattttattccaagtattttaaatatgaatttaagtgcaaattccatttgtacataaatcacatggtgtgaactttgtattaatatttacttttcagaaattcaaaaaaacatatactaaaatgaatgtgatttcatctaagggacaaacatactcgtatatattctcaacataaatagaatatttactttagaaagagttacatcaaatgtatttatcgtattgtattttttggattcagagatgtgtttgtcacatggatatatgctgtaatggtggggactgggcttctaatgtacccgttacccaaagggaagattttaccaaataagtaatttttcaactctcactcccctcacaccctcccttttttggagtccccagagcctattatttttattattatttatttatttatttttatttttattttttttttgacggagtctcgctctgtcgcccaggctggagtgca

SEQ ID NO: 258816 - DNA, 299 bp, Homo sapiens
tctccacctcgagacgcgcatagcacacagagctgcagaggccacgcagataaaccaccagcactccagactgggcaggagccgctgtcaggacagaggacacctatccacacccgcctggcctcagaagatcctgggtcaaagaataattctcttttcatgtatatgtgttgaaagaatttcagactagcaagcaagccgttttgactgtttcttaagatacgtagggagtttgttctttctttattagcagaaagccacgttttaaggattaaattttttccataagaacgtaagga

SEQ ID NO: 258817 - DNA, 504 bp, Homo sapiens
catggttttctgggaccagaggcattctctacaagggaagcaccaaagcaattaatgacttgataaaaacacgactctgccccattgccattcatgtcaaaaagggacacttgtagtgttagcaattcaagtacatatacatacaaatttataagagctactatgctttaagctatctttaaacaatgtatgtttttctctctaccatcacttggataatgaattcaataataagttgagaactaatttgttaaaatggtaccttcatttatttacactgtaagtcactcaattaaacttcaagtcttcataagagagaaataggccttctttctctttacttctgtgtaattcctgtaattctgtttcttctcttgaactacagtcctatttttgcatactaagttctcttaccctctatttatctctgcctccttcacaaatagggtctcattatgtgttctctgaaacttccttacatttgtcattccattgatgtaaacg

SEQ ID NO: 258818 - DNA, 235 bp, Homo sapiens
aaaatgtgtgtgctacaaggcaatttgccatttcattttaatagaatgttccatgctgaaaatgtctaactgctcagaagtggaataggagtgtaaatttattatctgagaaaagaaaattaattgacacaggccaaaaatgtaatggaattagacccatgtgccttagtgagaacttaggaactcgatctgggctctatggagtgacaaaattatgcaaaaaaaaaatgaagta

SEQ ID NO: 258819 - DNA, 983 bp, Homo sapiens
atgtgtaacccatgggtggcgtggttaggagtgctaccactctttatcctattaactcaggcagccctcaaaccagcaatgcctccggtgatcaagagccagcctttcaacattttctgggcagccccaacaatgtattgtatgccttccttcaacgtggatataaatcttcaagtatttaacattatatcaaatcctttagagactcagagtgggtcaaaaattgccatattttatccaaatgaattagggtattacccttacttatctcaagatggaaaatcctttaatggaggaataccgcagaatgtgagcctttctgaacaccttaggaaaactgctgatgacattggagaaggtgtcccttggtggagatcagaagaacttgttgttattgactgggaaagttggaaaccccaatgggatagaaatcagggcagcagaataatatataaaaaccactctttagccttcactagaaaccatcatccttattggtcagaaatgaaagtggaaacagttgcccgagaggaatttgaaaatgctggaaaaaatttcatgaacattactctcacattggctttagaaatgagaccaaaatgtttatggggcttttatctctatccagactgctacaattatgattacagaataaatccagagacgtacacaggtaattgtccaaattgtggctgtgggaaaaaagcgcagcactttatccttcaatacatttggataaaatactgaagtcaagcttaaatgctttgaaatttgttcactatcgagttagagaagccatgagggttgctgaaatggctagacatgactatgttttgccagtttttattttttccagaccattttatttgcatagtactgaagctctgtcacaggaggacttagtgcatgcaattggcgaaagtgcagcattgggggcagcaggagtaatattgtggggaggatatgaatattctgcttcaaag

SEQ ID NO: 258820 - DNA, 667 bp, Homo sapiens
ggccagcaaatcaggttgtgctcacacaacccagtatggcaacacgttcctcattgttaacaatggtgtggcatttttaatgagtgactatctttttaaacattgtattgaagtaaaacatatatagagggaataaatgaattgtaagtgtacagcttaatcaatttccagagtgaatacacccagatcaaaaataagagtattgctgcctgattttgaattctacataaataggactatataatatatattttcttatgttgacttctttcataattatatttttttaatttttatttttatttcaatggtttttgagattcaggtggtttttggttacatggatacttggataagttctttagtggtgattgctgaaattttagtacacctgtcacccaagccgtgtacactgtacccagtatgtactcttttattcctcacccctcctcccaaccttccctgctaagtccccaaaatccattatgtcattcttatgcctttgcatcctcatagcttagctcccacttatatgaaagtgaaaacgtacgatatttggtttttcattcctggattacttcacttagaataatggcctccagcttcatccaagttactgcaaaagacattattttatttctttttgtggctgattagtattccatga

SEQ ID NO: 258821 - DNA, 635 bp, Homo sapiens
cagggttgagcctcaatactgtgtccttcctgagaccatttctgcttttataacattttgtttatttgattattgaaactattattgctgataatgtggtgtggcctacactggcgcattgaaaacgtgtggtagccagcctgagtggtcaccaggagaaatggaccagaccagagagggtagtcccatccaggtttggtcacattgtctgagtatccaggatcaacggggaagcagagtggtatagtggaaagagtctaggctttgaaatgagagaggcctgagtagcccacgggcaagtcattgactcttgagcccttttccctgatctaaaaatggagataataatacttacagggatattaaaattaaatgagatgatctgtggcaaacactgagcacagcgtctggcagatagaattttaattaagagttaggtgtgaagtgaaaaccaaaccataaaaaagttgaagacaatataagttttatagcccactctatagttatggaagcactttctaacttcaaaagcaatggaaagtatcaaaaaacaaagagtgaaaaaattaatttgagtatgtaaagatccataattttgtacatgaaaacaaatatagctaaaaggtaacttggat

SEQ ID NO: 258822 - DNA, 293 bp, Homo sapiens
agcaggcagacacacaagcggctggacttctagaggaacacattggcagaagaagacacagcggctggacctcgagagggcgttgagaggagcatgccggcagaagagaacacgtggcggaagagcacatgacaaatgccagcaggccgtggaacgaagcagagtttggctggggcatttggagaagagcctgggccgctgagtagctgaactccaggggaaaaccatctcccttctggctccccaatctgctgagcattactttcactcaataaaaccttacactcattctc

SEQ ID NO: 258823 - DNA, 619 bp, Homo sapiens
gttttccatgatgattccaacacgctgatccttcatttgtctaaactcatagaaattttgttgttctgacaacttgttgggtacatatcagtatacgacattaatatatctccctgtccccaattaggttatcagtcacttgatggaggagattgtatgttatatattactttgtattcttcacagtgtctaatataaaggacacaagtcctttctaagaaaagagtgctgggattctctctacaactcaccaaaatatcttctgtcacatttcccatctaaactctgaaatataacccaattttattatttgtgaatttggaatcagagcagactctcattctcctcaaatcccctgctgtaatggatgatatttcttcctagagttcttagtatttttctgagggcctttaaaaaaatatagagccagaaataaataaggtgaggagcatagaacatatacataatagcctaaattcttctttttttttttttagacagagtcttgctctgtcactcaggcactcaggcagtggcacggtctcggctcacagcaacctctgcctcctgggcttaagcaattctcttgtctcagactcccgagtagctgggactacat

SEQ ID NO: 258824 - DNA, 463 bp, Homo sapiens
tatgattccgttgtatctcctttgttgacttctttgtcccatctcttcgctttctgttttagtggttgctgtagaacagggtttctcagctctggcactactggtattttgagccagataattctttgttagggggtggggggttctcttgtgtattgcagagtgtttagcaacatccttggcatctacccactagatgtgggtaatacccatccacacattgtgacagatatccccagggagcactcctaaaactacagctctaaggcttacagcataaatctttaacttatcaagcaaatgttatacgactgtatgtatagtatcagaaacttacaaaagtgtacttccctctcccacaccccatcttttttgtcatacatttttcttctacatatgctataaaccccacaacacattgttatttctactttttaaaataatcttttaaagagactttaaa

SEQ ID NO: 258825 - DNA, 659 bp, Homo sapiens
aagtaagtaacctcttactgaaattgtaactgactgtcaaaatgatactgactgttgaagattaaaatgtgaaaacattaaacgatttttttctgttgtgattgtgtctgtatatatatgtacataaacattctaactgtagtagcattctatttttgacacagatctgagaagcctggttaggatttaatcagatatgtatagatacctcacagatgtatttggaataatattctgtagcagaaattaaatctagtcccagccttaccctaactagtcagtggcaaagcagccttctacagtctgttactttgaaatgtatgtttcagaataactataaattaacagctttgatcatgtttatgccatgtaggtatattttataggaagatataagtaacattcaaatggagaaaaacccaatgttgaaaagagaaattgaactagtttaaattgccagtcactgtttctgcatatagatctaatttttttcataatgactgataattgtttctgtcttctaatatatacacacatatatatatttatgtatatgtatacatgttatatgttacatgtacatgtatattattttccagattttgactaaaactttctaattctatacctcttttattctggcttccaactaagcctct

SEQ ID NO: 258826 - DNA, 672 bp, Homo sapiens
gtcacttggtttctctggcctcagttttctcatctgtcaaatagaagtaacatttatgcttcagtagatctccaatgtcctcaagacagtgttcaaaccattaatataatctacaaaacccatcatgatatggcctctgctttcctctctgtcatcataccttgtacctcttctatcagcactttaaatccagaattctgaactactttcaaatccctaaatggcccatgctctctctagcttccaggattttgcttaatctgtttggctaaccagctaatcacagcctggctgtatccatcacttattccactctagccttaggtgacatcaccatcactaggaaacttttcttggcctctaaagcccaggatggatctatcatcagctcccacagcaacttgtgcatttgttgtaattatcttcatttttctacaatcctcagtagatttgaaatgaatgatttctcaatcttattcaacatatttctagggtctaaaagaatgcttgacacatagttgtctttcgtatgatatttaattgatttgaggttgtcatcaattttgagatgtgtcattatttcatctattactaaaaaaaagattgccaatgaaaccataacacatcatgaattgcaagatgcatcttgatttcacaggtgttaaaaagtga

SEQ ID NO: 258827 - DNA, 358 bp, Homo sapiens
gaaatgttccttttggctcagtaatagttctgcttcaatgcatgtgggctgagcctgccaatagtcatggaaatggtgcactgaggtttaaaaaagggacgtttgattgagaacaaaagtcacagagaacttttctgaaggtctttggtcagcacgagaattattctttaatggcacagggagaggggaatcttaagcagctctgaccttttatcaatcgtgaagaattggccatcattgtgtacatcattgaatttcaaagcatttaagctcttgcttatccagtactccccctagcagtctgcacgaagtgggttaactgggcactcacacactgttggtaggaggacaaatggct

SEQ ID NO: 258828 - DNA, 682 bp, Homo sapiens
ataaggctctggaaagaaaaggccaattggggctttgtctgaagaaataacagagtatttttctgccagagaaagcaagtccaagggaggaattttcagattgaccaaagagtattggtctacatcattagtactttcagtgagaaataactgaaaataaactagagcaaaagttccccaggtgtggttccaggaccagcaactgaaacatcacctgggaactgttaaaaatgcaaattcttgggctctccgccagaatcactgaatcagaaactctgaaatgggacccaataatcagcagcttaacaagctctccaggtgattcttatgccaaataaagtttgaaattccctggtgctggcgctggaagcaaatgagtcacagctgtgaagaatccctaccattaataccctgggtgggataaataaaaatgggaaactaaaaagttaaatgatcagaggttggctgtagttcaaaagtaaggatatacctgaatataaaattctttcttaacctaaatgcaaaatgggaatatgtttaatcatttatatagcatctcactggttttttccagcttgagacatgattcacaaaaattgtatatatttaaaatgtacatgatgttttgatatacatatacattgtgaaacaattaccacaatgaagttaacataaccatgaa

SEQ ID NO: 258829 - DNA, 737 bp, Homo sapiens
gctatatcttatatataaaaatgtacctttgaataatttctcagtttaactatttttagaaatggagcaaagttttgcccattggtacatgatattgtggattaagtgaaagaatatgaggctgggtgcggtggctcacgcctgtaatcccagcactttgagaggctgaggcaggtggatcacctgaggtcgagagttcgagaccagcctgaccaacatggagcaaccccgtgtctactaaaaatacaaaattagctggccgtggtggcgcatgcctgtaatcccagcgactagggaggctgagtcaggacagttgcttgaacctgggagatggagtttgcggtgaaccgagatcacaccattgcactccagcctgggcaatgagagtgaaactccatctcaaaaaaaaaaaaaaagaatatgacacagaattttatgtatagagttccaggtaccctgctcactacagactgaaattctgtgcagtctaataaatgaatcagagcctttccatcttgtctgggtagtccctaggttccctttttaaaggggttttgtttttagagtgattataaattcatccaacagtgcactttcagtgcctcctacctccctctaccaagtatgaactgcatgcatggctgaaatatgattttggctattatcgcttcatgtgcattgttcactattttgtaactgttattaaagtaaaatactgacttggaacatgaatttta

SEQ ID NO: 258830 - DNA, 274 bp, Homo sapiens
ttgaatcgtgggtcagaatttcctctttttaaagaccaatattccattacatgtatgtactgtgtcttactcatccattcgtctgtcagcgggcacttgggttgctcctaccccttggctcgtgtgaacagtgctgctatggttggacagtgccgagaccctgctttcggttctttggggtatatgcccggaagtggaatttctgaatcatacgggtattctctatgtaattttttgagaagccaccatattgtttcgcacagtggctgtgcca

SEQ ID NO: 258831 - DNA, 514 bp, Homo sapiens
cagggactatgactttgttcctggaactgagtagttacaaattcagctctgcactggatggtgagaacatagttactatggatatattcattgataataattcttcacttatttttcaatcttctgaaatgataacatcctttactggatcagatgcataggatcaaaataagtaaagtatgcatttagtttttgaccccttttcattaaggattattgagggtggccatataattttcttgaacactcttgggcaaacaagatatttggttattatggtacccaataactgatttgaagatgagggtcatcttttagttatttctgaaacaagcagagtgaaggcagatcctccattccaaatatagttaccttaaatttagcagttttggattaattacttgaccctttaattaaacttatttatttgatcctcatattgaaatgtatatcccttttccagaatgctcctatattcttaatgatttagagaaatgataactataattctctt

SEQ ID NO: 258832 - DNA, 325 bp, Homo sapiens
agatggaaagtaaagacaattataaaacatatcttttttgacaatttactcagtgttttattttgcttttgtttttattttgagacggagtcgtactctgtcgcccaggctgctggagtgcagtggtgtgatctcggctcactgcagcctctgcctcccaggttcaagtgattctcctgcctcatcctcctgagtagctgggactacaggcacatgccaccacaactggctaataattttttttttttttttttttttttgagacagagtcttgctctgtcgctcaggctggagtgcagtggcgcgatctcggctcactgccagc

SEQ ID NO: 258833 - DNA, 964 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaaca

SEQ ID NO: 258834 - DNA, 1054 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaaca

SEQ ID NO: 258835 - DNA, 650 bp, Homo sapiens
catcacatctacccccatataaccacaaaactctccttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacaaaagaaagcaatataaaattggcctcgctgggcctta

SEQ ID NO: 258836 - DNA, 2696 bp, Homo sapiens
  misc_feature (14)..(14): n is a, c, g, or t
  misc_feature (24)..(24): n is a, c, g, or t
ccaggtctgttccnccgcgggtanggatatcgtcgaccaggcgctcgggtcgataagctggaactgatgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258837 - DNA, 3191 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258838 - DNA, 3366 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258839 - DNA, 2754 bp, Homo sapiens
gctagctgaacgactctcttaatttccaccgctacacaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258840 - DNA, 3189 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258841 - DNA, 2666 bp, Homo sapiens
ttaataatttaataaaaagaattaataatttaactatcgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258842 - DNA, 2674 bp, Homo sapiens
atttaatataataatttttattaataatatgtaatttttctcatttcttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258843 - DNA, 2927 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258844 - DNA, 3167 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258845 - DNA, 2356 bp, Homo sapiens
ccagttacaacagctcagttacaacagctcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaatggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaaaaaagaaggagcagagagcgccaacacacaaacaatgtcgagcggagcaagggcccataaacaacctacgagaaacccaaaccctggggaaagcgcgcccccaagcggcacgcgacacctgggaaacaagggggacaaaagagac

SEQ ID NO: 258846 - DNA, 1286 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacattggccaaccttgtgtttcaaacaacaccaaaaaaaggggggcgccaaaaaatacccagggccccgtttccaccctttttaaagggcccaagaggataaaaaacaaggcgcaaaccgcggaaaacggatgtgaaaacatcgggaa

SEQ ID NO: 258847 - DNA, 1161 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggaggtaatgctttcagttgacagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaaca

SEQ ID NO: 258848 - DNA, 1461 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacattggccaaccttgtgtttcaaacaacaccaaaaaaaggggggcgccaaaaaatacccagggccccgtttccaccctttttaaagggcccaagaggataaaaaacaaggcgcaaaccgcggaaaacggatgtgaaaacatcgggaa

SEQ ID NO: 258849 - DNA, 1159 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacaggggtcctctagagtcacca

SEQ ID NO: 258850 - DNA, 1141 bp, Homo sapiens
tgtcggtggaagctctggtgtgattggttggctcttcttccaattgcaccaatctcaagctcttctctgcagagccctaactacaaaattgaaagtagagaggagggggcagccaatggaaaaaaaaatttgcacagcagccaatcctcctgcggcgttttgtgcctttgcccaacaggaaaatgtgtctcatgcagaggggcgttacccagtctccaatgggcgggagccggtggaacggaggagccaatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaaca

SEQ ID NO: 258851 - DNA, 646 bp, Homo sapiens
  misc_feature (14)..(14): n is a, c, g, or t
  misc_feature (24)..(24): n is a, c, g, or t
ccaggtctgttccnccgcgggtanggatatcgtcgaccaggcgctcgggtcgataagctggaactgatgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaaca

SEQ ID NO: 258852 - DNA, 420 bp, Homo sapiens
agtgcaacactgccatttatctccttcaatgagctaagcagccatcaggttaagaagagggcaggggagaggcgggcacagccttattgggatgatgctgtcccgctgctgactcccagctggtacggcagtgacctctgctggcaggattttcctctccagtgtgcacagagagtaggagttccctcggagtctgtgtggttcagtagtgttcttcagagagatgccccaagactgatgctcacggagagggccgactgggctttcctgctaaaactgtcactaaaggctggggttacacagtcaggagttgagacagattcttacccttgcttcagtgaactttctctcaaacacatatggcttctttacgttactcattttcagatctaaacatatttctttaaaaatatgttctca

SEQ ID NO: 258853 - DNA, 530 bp, Homo sapiens
ggtattctttctaaagtgcaacagtgtaataaagattatttctagatctcaaggaggatctgaatgatggctataatgaagggcctatttaggtaacttttaagtttgaggaataagagaatggggttagtccacttagggtttccgtatttcctcatgttggccactgaccaagtatgaatatagccatctttaggggtgggcgcggtggctcatgcctgtaatccctgcactttgggaggccaaggtgggcggatcatctgaggtcgggagttcgagaccagcctggctaacatggtgaaaccccatctctactaaaaataaaaataaaaaattagctgggcatagtggtgcatgcctgtaatccagctactcaggaaactgagacaggagaatcacttgaatccgggaggcggaggttgtggtgagctgaaatcgcgccactgcactcccgcctgggcaacagagtaagactccatctccaaaaattaaaattaatatcaaaaaaataaagccatctttaagtatat

SEQ ID NO: 258854 - DNA, 349 bp, Homo sapiens
acaggtgcccaagagctggccaataacaccatggtattgagaaactctcagtcttttggaacaggctctgttttcttctccgcttctcttccctatttccctcccctgtcctccccatcccccacctacagataggcctgaaaccaatacagttttcaagaggagagcctttttttttaagaaaaaaaaaaaaaaagtttaaaattaagaaatcaaagaccaggtgcggtggctcatgcctctaatcccagtactttgggaggccgaggcaggcggatcacgaggtctggtgttcaagaccagcctgaccaacatggtgaaaccccatctctactaaaattacaaaaat

SEQ ID NO: 258855 - DNA, 2768 bp, Homo sapiens
ctttgtatgggagctgttttcatgctatttcactctattaaatcttgcaactgcactcttctggtccatgtttcttacggctcgagctgagcttttgctcaccgtccaccactgctgtttgccaccaccgcagacctgccgctgactcccatccctctggatcctgcagggtgtccgctgtgctcctgatccagcgaggcgcccattgccgctcccaattgggctaaaggcttgccattgttcctgcacggctaagtgcctgggtttgttctaattgagctgaacactagtcactgggttccatggttctcttctgtgacccacggcttctaatagaactataacacttaccacatggcccaagattccattccttggaatccgtgaggccaagaactccaggtcagagaatacgaggcttgccaccatcttggaagcggcctgctaccatcttggaagtggttcaccaccatcttgggagctctgtgagcaaggaccccccggtaacattttggcaaccacgaacggacatccaaagtgatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcgggagtgctaggtgcactaggtactggcattggcggtatcacaacctctactcagttctactacaaactatctcaagaactaaatggggacatggaacgggtcgccgactccctggtcaccttgcaagatcagcttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggactgagagacaggactagctggatttcctaggctgactaagaatccctaagcctagctgggaaggtgaccacatccacctttaaacacggggcttgcaacttagctcacacctgaccaatcagagagctcactaaaatgctaattaggcaaagacaggaggtaaagaaatagccaatcatctattgcctgagagcacagcaggagggacaatgatcgggatataaacccaagtcttcgagccggcaacggcaaccccctttgggtcccctccctttgtatgggagctctgttttcatgctatttcactctattaaatcttgcaactgc

SEQ ID NO: 258856 - DNA, 422 bp, Homo sapiens
cagtccagacttcttttggtttagtgagatgatattttgttttcacactcaactttacttactgcatagggctccaaatgcatctatgtgccctttctgctttgcagacagtgttccaagtatctggctgcaaagattgggtaagtagagcattcataatggctttcacacatgcaggctggcctggggcacctgttggttccagatgtttatggccttgaccccggtgtgaatgtcatccctccctgcagtgaaggccgaatgagtggtcaggtggaaaatgttcctgccttccttatactggagttaacttccaaggtacagtccttccccatgcattcagaaagccccactccaagaagccaagctcaggtgtcctgtttcacctatgcctcggagtcccacccacattgaacctcaac

SEQ ID NO: 258857 - DNA, 415 bp, Homo sapiens
ccattaaaatatatatagaaggaaatccacctctggggtggcaatgattcacttaacatacatccagctgttgaaagtgatgatgccaggatatatttctcccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcc

SEQ ID NO: 258858 - DNA, 614 bp, Homo sapiens
aattatcttacacttacagaagtgttgcaaagacaacacacattatttccaaacacccttccctcagatccccctaatgccaacagtgtacatattgacatgcaataaattacacatgttgaaagtgtgtgataagcatacgatagtttgataagttttgacatacatattctctcatgaaacccatcactgcagtcagggtagtgaatacacctgtcacttacagacagttcctcatatctccttgtcattcctctctgtgcctgcacctctccctgcaatagacaactgctgatctgctttgcgttactgtggttagtttgtctagagtttcgtataaatggaatcatacagcatgtactctttttaaaattattacttaaaaaattgaggtaaattatatatttaatttaccatctttaccattttaaagtgtctagttcagtggtaataaatagatttataaggtcgggcacgatggctcatgcctgtaatcccagcactttgggaggccgaggggggcagaccacctgagatcaggagttcgagaccagcctggccaacacggtgaaaccctgtctctatttatcactgcccgcgtttaccgtcgtgtg

SEQ ID NO: 258859 - DNA, 663 bp, Homo sapiens
ggacctcagtaaatatgttgatggtccagacgaaaatgtgtagataatatccattcgtgattgaggccttgccttgacaaaccacttcttgtcttgaagacacactcttcaactcagcttctcacagaaaccaaaacctcagctcatggcagaaggctggaaccagagtgagaaggctggttgcaacaaagggtaaaatgcttccttaggggataatctaaggcagctaaaatacccagacccattgctatggtaatccacccacataataattacaggttatttgcatatctggattccttttcatagccaggggatggtgtgaagtcagtgctaaagaagcaacaagtggctgtcatgtgtcatctctgccccaagtggttctgaaattggtttgaagcttgaggagccttcattctttttgggataaaggataagaatcctaacagaactcacccccagtcatcactagtcagagagagccttctggcagagtaagtcagtcggccctggctcagcacacaaccccgaccatcgtcgaggcgaccgacacccaactcaccacgacgccacaatctggacgactgagccacccccacagcgagtccccaggctccctcccccggcgcccagccccgcgcctctcccccctcccgccctccg

SEQ ID NO: 258860 - DNA, 208 bp, Homo sapiens
aagtaatcatatgtacaggagcacgtggctctaggatccagacccagacaagggagtacatttctgatctacttactaagccctttcctctttactcaaaactcctttgacatcctttgaattttacctttataataattaaacatgatcgtaatatgctaaacctatttttaaaaccattttaatctattgttgacctttcccctaa

SEQ ID NO: 258861 - DNA, 391 bp, Homo sapiens
tctgcagatcaaaggacatttttcactaaaaatctctgacatcagagacagagactacatatctataatgaacctttccgaaacctgtccattagaaagccacttctcagtacagaggtggaccttggagactttccaggattttcacatccatctgcgaagaggaaaagaactcctgaaactgggctgacttcataaccagtttaatttcacacatctcacctttctggagctgccttgtttttcccttcttgcatcactgcagagaaaattcatggacttcctaaaggtgagactctgacccattagtaagaaagtcttgctttatgttaagttggctttctctggagatctcctaactgctttataaacattctttcacacctccaag

SEQ ID NO: 258862 - DNA, 395 bp, Homo sapiens
gatcactacacttgagcaccagtgtccctgggaacctgttagctatgccaattagcagccctccccagccccagtgcatcagaactctgggttggggcccagcactctgtgtttgaacaggccctgcactggtgctgatgcccaggtccgttgatgtattgtgagagtttcggaaggtgggggctctgccagtctcagctctccctagcaggccctggcccagtgctctcgagtgatgggccttccttagcttcatatgtgtgcgctcagtgagcgaatgaatgcatgcatggtgaataaacagaaagttcaaaacaagtggcagagaaattgagcatcagatacaaaaaaagctcggagcacttcattcaggcattcattcagccctgctgatc

SEQ ID NO: 258863 - DNA, 636 bp, Homo sapiens
tactgatatttagtaacttggatattgtgctaagtgctttacaggtattcttatttaatcctcacaaggcagtatggtagataatctattatattgaaaataatgggccaggcacagtggctcacgcctgtaatcccagcactttgggaggctgaggtgggtggatcacctgaggtcaggagttcaagaccagcctgaccaacatggtgaaaccctgtctttactaaaaatacaaaaataagcgtggcatagtagctcacacctgtagtcccagctactcagaaggctgaagcacgagaatcacttgaacccacgaggtggaggttacagtgagccaaaatcacaccactggactccagcctgggtaagagagcatgactaggtctcaaaagaaagaaagaaaataatgaacaaaaaatgttgagtgggcagtattaaattaaaaaaaaacctaatgtattaaagaaggagaaaagtataaaaattagtcaacaagcagagaaagaaagaaaatataaaggtaaaaatgtatgttatccaaatgagacctcttaagaagaaaaaataaaggaaattcaaaaaataagttaggaaatagtgagtaaaattatgaagttaaaaattcaccaaaaattt

SEQ ID NO: 258864 - DNA, 2395 bp, Homo sapiens
ctgaatatacagtggtggggacaaaagtaggctcaggagaaaatgaaagagaaagaatttgtttcacagtttggattcctgagactgtgaattgatccatcccatctcttcattttgagggagtcactacagttcctgactagccttcagattactttgcactggaacctatcccagttgaaccagctgtggaatttgggggtgaagggtgtgaggaagtggtataggacaagttgcctagtctcctttgctgcacatgggattattttctttaaaatgactatggacaagagatctattgtacttcatgatgactccagtaaataaccatgtattatatgcttgaaaattgataaaagagtagatttgaagtattcttaccacaaaacaggatgtgtgaggtaatgcatatgttagttagttccatttagctattccacaatgtatatgtatttcaaaacatgttatacatgataaacatgtacaatttttatttgtcaattaagaataatttaaaaagaagcagaaacaatatgggttatatttttgagctaagaaatatgtttacattgagatagttaataaaataatttttttcttaaaattattgtttccttcagaaggaataactgactttattttgtttacttcttacataatatttatcagtattaagtgttacaattttaaagaggaaagaaatgatacattttccccaagtaaggtttttaccaatttatattcaagaacacttatttatactttaaggtaattatttatgtatatctcttccactagacttagaagtccttaacagcagggtgtaaaatttaattttcatttctctagtgactatcatcttacctggattatagtaggaatttagtattttagaatgaataagacattagaaaatttggatttgtgttttatagtttattttctttttgagtctctctcccttgaattgttaaaagtaacctttaaattgttaatgtggtaagtaaaattaaataaaatctaaatgacagattgcttttaattctccttggttggaacaaatgttcaaagactatttagataggaagcagacaatagtttgttttcctttgctttgattgggtatatatttcaaaaatgacatgtgtaaattaaacacacacaccttctatttttgaggctttagaagttgttccccaagataagaaagaaacacttttgacctgtgagagaccatatctcctccagaactcattcaaataaattattttgtgatttattttaaaatttaggtataatttatacaatgtacaaatttgaagtgaatagtgaaccaacatctctatcatcccaaaaagttctcttgtgtccactttcagtcaggtgtgccatcccagaggcaaacacgtgtgcgagtgtgattctatcagtagattttgcctctttcagaacttcagatatgtagttatactgagtgtgcttatgctcctggtgtcttttgctccacttgctggtgttttatagattcatactcttactgcatgtatcatgctattgagtagtattctattgcatgaagttattcacctattgatagacatttggatggtctacagtttttggctgttatgaatataactactgtgaacattattgtatgtctttttgtgtatcgggggaaaccagcccctgatattcgatatgggtccttttctattttccctaagtgttggcctgtttgagaaatacagggaaagaatacaaaagggagaaattttaaagctgggtgtctgggggagacgtcacatgttggcaggttctgtgatgcccagcaagccgcaaaaccagcaagtttttattagtgattttcaaaaagggagggagtgtatgaatagggtgtgggtcacagagatcacatgcttcacaaggtaataagatatcacaaggcaaatggaggcagggtgagatcagaggaccggggcaaaattaaaattgctagtgaagtttcgggcacgcattgtcattgataacatcttaccaggagacagggtttgagagcagacaaccggtctgaccaaaattgattaggtgggaatttcctcatcctaataagcctgggagcactaggggagatgggggcttatctcttcccttatctacaatcgtaaaagacagacattcccaaagcagccatttcagaggcctccccttagaaatgcattctctttctcaggggtgttccttgctgagaaagagaattcagtgatatttctcctatttgcttttgaaagaagagaaatatggctctgttccacccagcccacaggcagccagcctttaaggttatctcccttgttccctgaacatcgctgttatcctgttcttttttcaaggc

SEQ ID NO: 258865 - DNA, 559 bp, Homo sapiens
  misc_feature (1)..(1): n is a, c, g, or t
  misc_feature (120)..(120): n is a, c, g, or t
nggggatatcctgtggttgagtcatatacttgtttgacaacagcgggaagaattcatccactatcctgtagagaaatccagaggtaatgtatgatcacaaggtatgaagatgccattttnttggttcctgaaaggagcaaatgctcttggaatggacagcatggtttcattttgtgtagtaatgctcttgctaagttctagctcttacctttggttcaactctgagagcatttagttccccatccccaacccagccaatgcaccacccatgaaaatctacattggaattttgatcagtcatattgatatgacagattaaattaagaaggattgccacatttgtaggattgtcttctagtcaagaagagatacctacccatgtaccagtattggtcttttactcagtccgaggtggaattttatagttatcttcagttaaggccttcacaaattttgtaaattactttttattgttgtgtaactgttctttttcctatcatattcatcagcttttcccccattgagttttgattcaataaaggaagacaaattatggaca

SEQ ID NO: 258866 - DNA, 537 bp, Homo sapiens
ctcttccagatgaagacagagagggttgataattttacctatgaagacactgaagcacagagaggttaagtaacttgcctgagatgacacagctagggagcagcagaaccaggattcaaaccagactgacttaagaaaacatattcttattcacaaccctatgcaacttctctaatttttaactggaagacaaaatagtgttgtatctaactctctcaccagatggttaatgggctatgcactggaactttggatacatgatatgtgggtaggaaaataaattaaaactacagtcatattgaatgatttaatgtaaaattaatgtcaatccctagatattccagtggtgccacttccaaagtaatagtttacatcaaggaaaaaggtaccttattcaggaaagttaacttctagttccctggtcacccactgtcattttctttttactgaccactaggtaacactttcttctgttgcagaacaactgtccacatgtttgctatcaaggaaggcgataattaaagatgtatgttcaga

SEQ ID NO: 258867 - DNA, 436 bp, Homo sapiens
aatttttatatatagtatctaaaactcaatttaaattcaagacacaataggagacacaataaccctaaggaaaaaagaaaatcaactgtagacagtaggtagactagacaatggagtttttagaaatatattttaaatgcttaatttgttaaaagagatgagacaaaattgagaattttagaagagaactggaaacaacaataaaaaagaccaaatgaaaactataaactctagcaatcaaaattaagaactcggtggatacaaccacagcagattagaaacagctaaagagagagctagtaatttaaaatagatcagaagaaaatatcccgaatgaaacatgaagataaaaatgagtggaaaatttagaagagaagagacgataaataggaaatacagtgaggaaggtctaatgtgtaacggaatagcagaagga

SEQ ID NO: 258868 - DNA, 424 bp, Homo sapiens
ctgccactgccaaaaactaacccgactctcaactgaaaaaatgaaacctcctctgttagaagcaaaaattctccttgattacaacttcttagacttaaatttctttgcacagttcaattctaaattacaattgttcctatctgctgtagacaagatctttcatttaaatcttaactagatgttggtgtctgttcttcgatgccacacttcaactgagtaactgcaaggcaatgaatacgtgtgtatgaagtaagtgaccaagtcttgaggttccacatattttcagaaacgtggtcagatttgaagttgaatctgagggtttgagttaaggaaataagcttaaggagacaagatcattcaccacaatgtcacacaggcagaaatcagatacaaatcagagaatgccagaggtgtgataaaatag

SEQ ID NO: 258869 - DNA, 448 bp, Homo sapiens
gcacacacaaacacacacacacacacacacacacacacagagagaaggagtttgggtgtgttcaaggaagattaaaagtagatgccaaggtaacacaaaaatgatagaaatttataacaggattttataaggagaccaattttatttccatacatagcttttattttggtctctgttttccaactttactccaggaaacacactacacaggctcccttcttaagtgctggtgggccactgcacatgcagacagcccactttaagggaagaatcaggggagaagagatgcagaccccagaattatgccaacatacaaaagcctaagtcaaaggtcaaaccacacacttgaaatctcatcacctgtttggccctgttttaagtgtgctttactttctttaatttctgctctaaagcttttaaataaactttcactcctgctctaaaattt

SEQ ID NO: 258870 - DNA, 389 bp, Homo sapiens
tcagtgtgttattgggtccttccaagggaagtgacagtacatgtctggtgaatgagcttgtgatgagtgaatgggattccctcccaataggcaactgagagcaaagttctgggtggagggtccttggtgcatcctccacttactcttcatgccaatgggtacctcaggcctgtctgtccaacctctggactttcttaactctgccccagtctccagcccctcccctgtgtggctggggtaaggcagagtctgatcccatctggcctggcctgtgcccagaagtgcccaagaggcaagtgtcctcttgcccacaggaccccaggagaatcgcttgaacctgggtggcagaggttgcagtgagctgagatcgcgccaccgtactcggtctc

SEQ ID NO: 258871 - DNA, 379 bp, Homo sapiens
ccctacagatggacttagtgttatgcaaggtccttacagcgaaacggccagctttgcagccctctcagggggcacgctgagtggcggcattctctccagtggcaagggaaaatatagcaggtaaacaaatagataatttctgacagaaatggttagaattataagaagtaacacattgagccatttctctgtgccaggcttgtgccacgtatcatcttattttgatttaattgtcaatggttttgttttgttttgtttttacttttttatttttggggatagagaatcgcttgaacccaggaggcagtgattgcagtgagctgagatagcaccactgcatgcaagcctgggcaatagagcgagactccgtctcaaaaaa

SEQ ID NO: 258872 - DNA, 545 bp, Homo sapiens
caagctaatgccccccagctctgctaagaccctcacccccaagactccagggtgaaaataactaacctggaactagaggtgctgatgccagggagagccagcttgccagggtgagtgcaggagagcaaggccagagctgcaaatctccacacagcttttcgcagtggccactgagcaaggctggttcttgaagggattgtgacagcccctcctgaccatgcctccaaaactcttagcaactgctttcctctgaaatgaagttccaaagagctgctccaaaaacagtatatccattgcaagatgaactaacaatgcatacttgtgtggatctatttatctgcacaagtatttatccacaccttgtgggagagtgtgtgtgtgagagagagagaaagagagtgtgtgtgtactagtaagactgtatccttctgcacatatgtgctagagaaatgggtatactcatgtaatgaattgaaatgaagcaatactgtgcctgagacaaaaaaaagcccggcctaataagctgaagtttcttgctgcaggcc

SEQ ID NO: 258873 - DNA, 875 bp, Homo sapiens
attctttttacatgatatgtttctacacgcacatgatagaggtcttttggtttttaaattctcaatacttaaacctaaatatatcaaagtaaaagtatgtgaaaaaaaactatgctagttataggttgaataatgtcccccaaaatttatacattgaagccctaatctcagtacttcagaatgtgactgtaattggagatagggtctttagagagatagttaaattaaaatgaggctgctaggttggccaaagtgctgggattacacgcgtgagccactgcgcccggcctagtttgtgctttttacttaccagttaggggttatattactgtgtaacaaaatggacggttatttctattcattaacaagattcaagtaatagcctctttagccacatattccttaataacacctttagaccttataggggtaattattttctatatacttttccaatgtatttgaaagtttgttggctcttcttccgtaattatactatatcctcagtaaagaaagtttggcatacagaaaagttgaaggaagaaaattttcaatcactgttgttccactaccaagaaataatacttggaggtatttcctttcaatcttcaacatgaggatgctaatgtccccctcataaggggccttaaagtcactgactctgtgcactatttcatgagaacattgatgtgggtatttaaccgaaagaaaacttgagttttctttttttcctttttattgtgaaaatttggaaacttattcaaaaagtagaatagttaactaattgatgtacccatcagcaagcttcagtgattaccaccatttaattttgtctgcacccccccacccactgccaccccagcccattcccagca

SEQ ID NO: 258874 - DNA, 771 bp, Homo sapiens
attctttttacatgatatgtttctacacgcacatgatagaggtcttttggtttttaaattctcaatacttaaacctaaatatatcaaagtaaaagtatgtgaaaaaaaactatgctagttataggttgaataatgtcccccaaaaaaagtgctgggattacacgcgtgagccactgcgcccggcctagtttgtgctttttacttaccagttaggggttatattactgtgtaacaaaatggacggttatttctattcattaacaagattcaagtaatagcctctttagccacatattccttaataacacctttagaccttataggggtaattattttctatatacttttccaatgtatttgaaagtttgttggctcttcttccgtaattatactatatcctcagtaaagaaagtttggcatacagaaaagttgaaggaagaaaattttcaatcactgttgttccactaccaagaaataatacttggaggtatttcctttcaatcttcaacatgaggatgctaatgtccccctcataaggggccttaaagtcactgactctgtgcactatttcatgagaacattgatgtgggtatttaaccgaaagaaaacttgagttttctttttttcctttttattgtgaaaatttggaaacttattcaaaaagtagaatagttaactaattgatgtacccatcagcaagcttcagtgattaccaccatttaattttgtctgcacccccccacccactgccaccccagcccattcccagca

SEQ ID NO: 258875 - DNA, 322 bp, Homo sapiens
aaggggaagcctggctccaccactctgtcatggcagtgctggccctaaggctgtgactctcctggcatgtgacaactccttaggcagggccatggggacggagccaaagaattgccagtggggctctgaaaggacaagtcaggaagcaggagctggcgaggtagcagaggagaggaccaggagtatgacctagaacagaaaagtgttttccatctgttctaaccagctgggaaccactttaaacaaaatgttaggtatcaaatctgagtgatgatgaaaggaatttcaaatctgagaaagagcaaaggtaagatatttcttc

SEQ ID NO: 258876 - DNA, 345 bp, Homo sapiens
gatgtttgtggcttgttcttggaagtgcttctcacgtagatgcccttatcccgtgtgtgcatctgcgtcctgcactgccagtggctgccctttgagaaccgggtcactcccttattgagttgtttgtctcatgtgtctgttggacgccccctttgtgacgggcactgtctgagccctgggggtaaaccgggcgtgacgacaccccaggtgtctgttctcaaggttgcccatcctggtgcgttcctctctcaacctgagcggaggcgatgtgtacttggttcctccttcccctctggttaccaacagagaagagttgatcccctccctgttttcagttgaaaagca

SEQ ID NO: 258877 - DNA, 526 bp, Homo sapiens
acagagtggatcaaaactacttaagatttgatggatcaaggaaggcttcagaaggaaatggtgtttgggacaattatagtgtgaggagaatttggaggagatggtaacagaagacaaagtttggtcaatccaagtggaatgaaagcataagttgaaacataaagttaaaagtcaatatggagtaggaaagtttaggcaatagtaaattatttagagtttaaagttaatagggaagtagaatggtgaaggagaagtgtagaaatgcaaggaggagccaggtcatggagggtctttgatgctaggtggagtagactgaatatattcaatggcaagtcactgaagaattctaaactgaatgagtttatgacttggcttgcattcaggaagacaaaactgtcaacagtatatatgaggaactggagtgagtaggtactagaggcagggaagccagaaacagattcaattgtcaagataagaagtaatgagggcctggactggaacaatggcagtaggactataaggaaaa

SEQ ID NO: 258878 - DNA, 444 bp, Homo sapiens
gtgggcatgatgccgaaggcttctcgcctgcttcttccttgaaacagtccctctttcccactccccattaccttgtaatttgtataaatgacttccaatcctttttggaaaatggtggcatataacccaaaattccctggacatgacatcggggcaccagaaggacactagaaagggcaccatggatggcactggtccgtcccgatgccccgtgacacactgagaagctgacttgtagaagtccgctcttcgtgttttattctgaactgccttcaaaatggcatttaggttttcctggagacgctgactttatcagtccttaaatggccagcagggttgatactcactgacatggaatcttgctcgctggtgagaaagtctgctgttctcttagacttgggaatcgtctcgtggaaatatacacttttttgttatttacaataa

SEQ ID NO: 258879 - DNA, 212 bp, Homo sapiens
atatcgagtctatcattttgtgaattgccgtcccacccctccgcatccctcccctttccctttcctccccaccccgtcccccccatttcattcgctttcttcctctcttccaagtaataactgcttatcagaattcatggctctcttaggatggagggaattaatttcttttctctctctctctctttttttttttcgagacaaggtcttgc

SEQ ID NO: 258880 - DNA, 594 bp, Homo sapiens
aggacacggaacacatctggttggttctcctctatacccgcactatctggcacaaatagtgattggatggatggatggatggatgaatgaatggatgaatgagcaaatgaatgaatgaatgagcaaatgaattaagtcctcaatgaatgaatgaatgaatgaatgaatgggcaaatgaattaaatcctcacttccagactgacagctcctccagggcagggtccttgtccaggtcatctcagtagcctcccccaccgtagagtggtcactcaatgaatgggggttgaatgattaagtggcccaaggtggcccagggctcaccactgcagaaatcagaccaaaagagctagaaccaccccagagagcccttcaggggacctccaagataacacaggaggaagggtaccaccttcctctctgccagtaggccactgtgcacagttgagagtccaggcctcctggggggaccggatcatttccagaacaactgctatgcaccaggtggtgtttggggtaaacggcatccctgcaagggatcctcacccccttttcttccttcattctctgctggtgtcaatcacagcttctagcaga

SEQ ID NO: 258881 - DNA, 410 bp, Homo sapiens
cctatgacagacaaggcaagctctactctcagaagcaaaaattatatatctaggagtcagagtatgaatcaagaagaatggacttctgcttcttatctacctaatgccagataatgatgacagcaatgcattttctacattcatatcctcaatcatatgtttttgaatgcttactggaaaaccggtttaaaagaaaggtgactagttattggtcttgctctgacagccgtggaaaccatttgctgatgaaagcacaagcaacaacaacaaaaaagatgaataaactggatttcaacaaaaacacatttgtgcttcagagaacatagtcaagaaagtgaaaaggcaacccaccaatgggagaacacagtttcaaaacatatatctaataaaatatttgagtccagattaaa

SEQ ID NO: 258882 - DNA, 464 bp, Homo sapiens
tgggaaacacagtgagaccctgtctctaaatttaaaaaagaaagaaactatgaaaagaaactgtaaaaagcaaagtaaatccaaagcaagcagaagaaaggaagcagaaatcagtaagatagaaaacagaagataagaaaagtaaaaccacaaggtagttctttgcaaagatcagcaaaattgggaaacctttagctggttccaaactgtgctaaaaaggcaaaggacctataatgtccaaaacaattttgcaagagaacaaagttggaggacttacactatctgatttccacaccaactataaaaccacgatagttttaagaccacgtgtttttctaacaaatggcactgggaaattgaatatgcactgctaaaaacaaaatgaacttagacccttcatactgtttgcaaggttaactcagaatagctcatatattgtatatagagttaaagccataaaaatt

SEQ ID NO: 258883 - DNA, 502 bp, Homo sapiens
tatgggtgatgttttgtcatctttattttttttcaaagtttccctgtagtggccttctcacacaaagccagaggccctccctaacactgcttacagaggtgggcctagaacagacatgaatggacactgcacctggaataccagcacctggtggggaggtttggttccatgtgcacctccacatacaaggcacgaacatctcagatctgggagtgcccaggacccagtggatgctcagtattgtaggaaagcaggtctttaccaaagttcttggtttattgctttcaaacttctttgcaaccttcagtaagaaacattttctatcataacctctttaacacatttatagtgttagataacactgtaactatatataaatataaatataacacatgtatataaataaatataaatataacattttatagtataacattaatatgtgtatgggatccagttttatatgtttaattttcataaaacattcttgttacgtgtgatg

SEQ ID NO: 258884 - DNA, 490 bp, Homo sapiens
tcactatagacaaggaccgtataatagacgctggccccaaaggaaactactctcgatttatgaatcacagctgccagcccaactgtgagaccctcaagtggacagtgagcaaaggtcatatctttgaaaaatctgtgaaatactcctgccaaaaagaaatacaggggcaagagaaatactacagagttgccattggcaacactgagaaatgtgggaaactataagaccagtaagccatactcatcaacagggaaaaatgaaggggactgatgacaagagactggaggaacatggactaatttttattgtagggcttatctgtgtttgtgtcagatcagtttgttagagaaacagctgaatatcatttgtgatatttgagacagaatttggaacactgattatatttattattgaggaattatttttatttttagctgtgatagtgggtttgttatgtttagtaattcctcccttttagaggtgcatacag

SEQ ID NO: 258885 - DNA, 721 bp, Homo sapiens
ctcacagcaggaaattgaatcccaaagatgtcaagtaactgatccaaagtcacaaggctgtatgtgatgaagttagaactcctgcagggcctgacctctgattctgtaccctgggaacttactttgttttgcctcttggaaaactaacatacagcagtctatatgtgcatggaagactgagccattatatttctgccagtcagtgtggcagtgtacttctgcctgatatttcttcattcattgagtatcagttgtgtgccaatgatgagccaagacctatgtcctcgttcccatgggttttataggcctgtaatgggatgaaatggggagggacagtgagcaaaggtcatatctttgaaaaatctgtgaaatactcctgccaaaaagaaatacaggggcaagagaaatactacagagttgccattggcaacactgagaaatgtgggaaactataagaccagtaagccatactcatcaacagggaaaaatgaaggggactgatgacaagagactggaggaacatggactaatttttattgtagggcttatctgtgtttgtgtcagatcagtttgttagagaaacagctgaatatcatttgtgatatttgagacagaatttggaacactgattatatttattattgaggaattatttttatttttagctgtgatagtgggtttgttatgtttagtaattcctcccttttagaggtgcatacag

SEQ ID NO: 258886 - DNA, 351 bp, Homo sapiens
gacatgatctcagctcgctgcaacctgtctcccgggttcaagtgattctcctgcctcagcctcctgagaagctgggattacaggtgcccgccaccacgctgagctaaattttgtgtttttaatagaggcaggttttcgccatgttggcccggctgttcttgaactcctgacctcgggatctgcctgcctcagcctcccaaagtgctgggattacagccgtgagccactgggcccggccgaagagattgtttttaaaaatacttaggaattacatgtaactagcttaaccatcaaacctgttaaattagtggaatcaagctcaagtttctcactaaaatttttgaaaagtgt

SEQ ID NO: 258887 - DNA, 610 bp, Homo sapiens
agggatatgggggaaaaatgtcctcaaatgcttatcatgaaaaataccatgtatttacattatttcaggaattaatcttttttacttttaatgatatgaggtgtattgacagagtttctttgtctgcctcatctttctgtggggatatgttgaaaggccctgcaagaaaccagaaacttgatttaataacttgccagagcaactgtttagcatctgtcctcaaggcaaagagttgaactgatagatttcataaagaaaatgaggaatcattatacacttcatcggaatttcatcacttgttagaaatttactcaaaggatcataaattctgtatttttcattattcaggaattctgaaaaaagagtgtgcattttgtgataacaaaaattctggtagggtatgagaaatccatccttaaagaagaaaagaattcacaacttcaaatggatgctgttttctcatgaaggatttgcccagtggctggagagtgcttctaatattattatataatataatattatgggtgtagatgccagttttgagatgatgtttatcagcactcctgttcttgaacagtgagaaggtatttattgggcatgttaagaacag

SEQ ID NO: 258888 - DNA, 415 bp, Homo sapiens
aatttttataaactttgtaaattaagaattaagtatttgcagaattctttcaaggtaccaaacactatcctcactgctcagaatacaaatataaacaggttgttccagcccataaaaagttcacagtctagggcctgggtgcagtttctcatgcctgtaataccagcactttgggaggctgaggtgggcagatgtcttaaacccaggagtttgagaccaacccgggcaacatggcaaaaccccatctctactgaaaaataaaaaattagccagacgttgtggcacatgcctgtagtcccagctacttgggaggctgaggtggaagaatcacttgagcccaggaggttgaggttgcagtgagctgtgatcatactactgcacttcaacccaggtgacagagcaagactctgtctca

SEQ ID NO: 258889 - DNA, 371 bp, Homo sapiens
agggaaataaagccgttgctgctgcagcaaaatggctcaaagtccaaccaaagtctggccttttcctgagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaaggaaactcgtgcagggccactgaaaagtcaggggaggctcagatgttatttcccacggattcctgtttttccagaaacgttgtcaccaaataagtatgagactgttaatttggagaaacaattagcccctacaaaaaaaaaaaagaaagaaa

SEQ ID NO: 258890 - DNA, 366 bp, Homo sapiens
gctgtcagtattgaggatttctaggggtggcaggcagaggaatccccttcagttccactcttgattttcacaatcactagattcacctctgcctggtatggagatgagaaatcaggagactcttcattcaggcaaaccgcagtagaactgtgctgctcatggccacagccaacctccctgcattgtttctcagagggagttcagttgaggagtctatagaagtagaaaggacagacccctctgtacattctcctgttactttcattgtgcttgccatgtttctactacctgcatggggttagagatgacaattaaaataataagttttccaggaagccaaagatcttccaacaatttgtgctggga

SEQ ID NO: 258891 - DNA, 440 bp, Homo sapiens
agaaattgcaaagtcaaaaatggggctcattgcagcaggaatgatgaaattgcttttagatagagaggtgaagggatttaaaacattaacttgttttaaaggtatcactgtttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaaactgttgaattagtttgcttttgttgcattaaaaaaaag

SEQ ID NO: 258892 - DNA, 435 bp, Homo sapiens
ggtcctggaagataactgctccctcaccaagggcagaggaactgatgtcactgtcaaggtcacaggggacaatctggaccacactgtcccctaatatgttcatcaatgtattagattatcttagtttataatttaggaccaaatacatctcttatggaaacattagcaccatgtcttttgatgtggattaagacatgattcagagaaaattctgttgcagaagtcattgacacaaacaatagtctttcatggtcttatgacagcaacatttatatgcatttatgaaacttccataatcattgctctatataattaatgttttcttagaaaataaaatcatgtcactataggcaaattttattttaactttgaacaattcaatagcatttattctgtgtttactaggcgcaagaacctgtgcaaaataatatgtaa

SEQ ID NO: 258893 - DNA, 372 bp, Homo sapiens
ttttgcctgagctattgtgaagtccttaggaaacacacgagtttggaatggagggaatctggagttcaactctgcacaagttaactttaaggagatgtcatgtcaatacaatgggatgtgaatctatagtaagattggaggttggggctgtggaagtatacatttcagagttatcagtatgtatctggcatttacagtcagaaggctacgtgatgtcacctagagataaatgtgtagagaaggatgagttctgggaaaggatctctagacctgccaatatttatagatcagaaaatgatgaggactttgggaagatccagccaatgacttgataggacaataggaagatttcagagtcctagaagccaagta

SEQ ID NO: 258894 - DNA, 365 bp, Homo sapiens
cagaatgcaacttgtattgttcctctggggaaatgctagcacctgcctggctcaaggtaggcactcactaatgaccctggcaatgcatgaatggttttctgaccagtgatgctcgtgacagcacactctgaatggtaaagtatctctacacccctgagaaaagctgtggctccagagggaaaaggaatgaggacaaagccatagcactgtagtcaaagagaggggcagagggggaaaaccaacacaagattggcaaatttgctttgtgggtacaaggaggcatcatcctaatgtttcaggtggtgctttccaggaggaaaggaatgccttcaattatgaaaagtaaagcataagatcttgttatt

SEQ ID NO: 258895 - DNA, 1488 bp, Homo sapiens
gccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 258896 - DNA, 662 bp, Homo sapiens
caggttttccagaagcaggcaccaatacagagttagaaacacaacaaattgatagagggtattgcctatgaaagacaaaggagtgtggctgcaggagtttgtaggcgaagccttcagaccacaatgcaggtctgacttgttttggtggtgatatggtttggctgtgtccccacccaaatcttatgttgaattgtagttgccataatccccaggtgtagtgagagggaccattgaatcatgacggcagttacctacatactgttcttgtgatagtaagtgagttctcacaagatctgatggtttttttaaggggcttttccccttctcctcggcacttctccttgctgctgctatgtgaagaaggatgtatttgcttccccttctgacatgactgtaagcttcctgaggccccccaaggcaggccgaactgtgagttcaaacaatggtttgaactagtgctcaaaaaatgtgtgttaagtcaatgagtgaatgaattaaaaaaatgagtccagtagataaaataaatgttgaaagagcaacaatcaataagattctgagtttccttaggacaggtatccaaccattgtttttgtatttccactgccttgcacattgcttgatacaaactcaataaatggcgacaactatgtaaattaataaat

SEQ ID NO: 258897 - DNA, 443 bp, Homo sapiens
tattccaagttgataggtcagtatttccacacatgtacaactaattacaatgccaggctctgataatgcactattttaccctgggctatgaaagattgtcacagtgaacatcaagtccccctctctatcatagcaactaaaatcttctatactttaaatcaagtataccacttagaaaagttcttctagataatcatattttagtaggaggaacaagacaatctcctatcataattaaaaggcacagttcagggggacagtaatgtttgaaaaattggctttcttcaaacttcactgtacattctactcttcatttactcatcagttcaacaaaaataaacaaaagaaaaatccaagtccctctctcaaaccattccaactagtttgatttttttgagggagttttacaagaattaacattaacagaaatgaaaatgaatgct

SEQ ID NO: 258898 - DNA, 366 bp, Homo sapiens
tcctattatttaagttctgagatttttttggaccgccacggtggtgtgaatttagagtcctaatgggtgtgtgcccagctcccgcgattcagattctcaggggagagtcatttctcctccacctgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaatctttttttatttttatttttatttatttatttttttgagacagagtctcgctc

SEQ ID NO: 258899 - DNA, 445 bp, Homo sapiens
caaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcagctcaagcttgcggattttcactgcacaaagttgaaaatatgaagaggattaggagacccttttcttctccttaaaccctaggaaggaagaagtggaacaaatggtaaagacagcatggcttactaactttccagtgttcactggaatactccaagaccaatcatgttcatctttgtatcgtcacagcactgtacctgacctcttacagtgatctatagatctatagatgtttgttgatgagttaataatgagtaaataaatgattcctttttctctactgttt

SEQ ID NO: 258900 - DNA, 305 bp, Homo sapiens
tttacttgtcactgacttgaagctcaagcttgcggattttcactgcacaaagttgaaaatatgaagaggattaggagacccttttcttctccttaaaccctaggaaggaagaagtggaacaaatggtaaagacagcatggcttactaactttccagtgttcactggaatactccaagaccaatcatgttcatctttgtatcgtcacagcactgtacctgacctcttacagtgatctatagatctatagatgtttgttgatgagttaataatgagtaaataaatgattcctttttctctactgttt

SEQ ID NO: 258901 - DNA, 512 bp, Homo sapiens
cagtaacagtacaagcagagccctgttactgttaaaggcagagcttttaatgctgatgaaatggagattaccagggctgaggcaggacctcacagctcagaagtgacagcccattccaacaccttggacatcagattcctaaacgtctgaatgttttcacgccaacaaggacttgggccagatgatttgtgacttgaggactgaattctaatagttaaaaaagtaactgaaagatatttaaatgaattagaacggaatgaaaaataaacttgaacttataatattattttaaaatttgggggtgctatgtagcaaaataaaaatcagtgtaagcagtgagaaaaacctaattcagaaatgaatcgaaacttggtttgtttttttcaccaccagagaatagggaaatattagtcaaagagagggcatggaagaagggacatctaatgtgaacgaacttcatacttactacttaatgtagataaataaaggcattctttattaaatcaaaaaaa

SEQ ID NO: 258902 - DNA, 431 bp, Homo sapiens
tcagaaacacacccagcatcgggccacacagagggtgcatcctttctggtagctctagcagggatggggtgcataggcccaggcctcatcttggggaagcagctggggatagggagcccactctggaaggccactcccacctcctgcacactcagtcctgggttcctaggctggaggcacagactggggcaagcaggtacttgtctgggcagtgctgagcccaggagcccagcctgggaaatttccagttgggtagcccactcttggtccactgcagcaggagaacctgctttaaattctccacattgccggccaggcgcgatggctcacgcctgtaatcccagcactttgggaggccgagacgggcggatcacgaggtcaggagatcgagatcatcctggctaacacgatgaaaccctgtctctactaaa

SEQ ID NO: 258903 - DNA, 484 bp, Homo sapiens
tcttaccctttaactttcataaaagagaagcctgattttgttcaggtatctagccttctcccaaagaccctgtgtggcttgaaggatacctttgctggagccatggataggataaatcttgatcagtaaaacaattaggaaatcctgtacttttgcaattggttcggaatgattcgtacatgacaaaggacacacgaggcaatttggaggggctctcattggcgaaatctggcaaaatttgagtatcaaaaagataagatggtaccattgaatagaaagagaatcgaactccatagggatttcaaagaaaaagaggttggggagggtgcagagaaaaaaaacaacagcatctttatagaagagtgcccctaaaaaaatgcagaaagagagagtgagaaaagtaccactttgctaccaccaaatgtaataattgattaaggtattttcaccattgagtgggaagttaagaaatgaaacatgtatt

SEQ ID NO: 258904 - DNA, 838 bp, Homo sapiens
caggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaaaaaaaagct

SEQ ID NO: 258905 - DNA, 1918 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagaggtgtgtgcacaggactgtgtctgtgtacgtgtgataacatgcatatggatgcaggtgctcagatacctgacaccttaggattcagacaggaaactatatctgcacatgtgtacttggtgcatgtatgtgtgcgtgcacaggtgagtgtttcagggtgcatgattgggggcatgtaaactgcaagcataaatgtgtacatgagtgtatgaacacaaatacataaggttgttcagg

SEQ ID NO: 258906 - DNA, 700 bp, Homo sapiens
gtgattcagagttgatctatccatcctctggttagactcagcatttcatacctgcctgtccagctccatcatcagccatcatggtcactgtcaccatcattcttcaatgacatcagagaagagagcttccctatgaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggaggtaccagaatggcagagttcgcctcagaaggctccagggtctggagaggaggagctggtgcctgctggagaggggctgatgttcataggaggtccctttctgcctgtccttgcagtgggatctggtgtgtgagcagaaaggtctgaacagagctgcgtccactttcttcttcgccggtgtgctggtgggggctgtggcctttggatatctgtccgacaggtggggtgaggcactgggccaataagaaa

SEQ ID NO: 258907 - DNA, 2334 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatatgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagaccaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaaaaaaaagct

SEQ ID NO: 258908 - DNA, 2632 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggaggtaccagaatggcagagttcgcctcagaaggctccagggtctggagaggaggagctggtgcctgctggagaggggctgatgttcataggaggtccctttctgcctgtccttgcagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatatgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagaccaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaaaaaaaagct

SEQ ID NO: 258909 - DNA, 1901 bp, Homo sapiens
atttttgagataaggtcttgctctgtcgctggagtacagtggcacaatcacagctcactgaagcctcaacctcccaggctcaagtggttctcctgcattagcctcctgagtagctgggactacaggcgtgtgccaccacacccagctaatatttattttttgattttttgtagagacagggtcttgccatgatgcccaggctgatcttgaactcctgggctcaaacccaccctcccgccttgacctccaaaagtgtttggattacaggcatgggccattgcacccagcccagaggtggcttttaaactgggcattaaaagatgaataagagctcatcaagtgtggagggcttggggaggagatgatgttccaggctaaggggactacatgagcaagagcctggaagttgagagcctgtagtatgtccaggaacatgtggcttagggtcatgactttctggctgatggaccttctgcctattcctaggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatatgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagaccaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaaaaaaaagct

SEQ ID NO: 258910 - DNA, 2252 bp, Homo sapiens
tgggagctctgctgaccaaggggctaggggctcacctcctatgccatcacccagctacctcatcatggtagccttggtccctgaacactaatgggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatatgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagaccaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgagtaaaaaaaagct

SEQ ID NO: 258911 - DNA, 1791 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggtgagggtgaacgtgtgtgtgagcatgcatatatgtgtgtggtggggagtgggctgtgtcaagtgcctccctcccagagcccaccatatatggcaggaaaagcccctgggcccccacagagagttccgaactctttaggatgtcctacctggctccagtgggccacatccatcattcgagaccaactcgtctcagctgccatgagcatctccatccccaccactgcagatgggaggaatagagaggggtggggggagagtactgtgtcccattgagatcacatagccaactctgatgttacaacctcacctccttccctaccaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccggtgagcccagtcccataggttctgcccaccccagaagccgggccaggaaccctgcccactccccggagaccccacctcctggccaagaacccactcctc

SEQ ID NO: 258912 - DNA, 933 bp, Homo sapiens
gtccgccaagtggcactgagactcctttcaggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcaggtgaggaagcctgcaactgatctgggggtatggggcttgttagtcacgtgtcttaaccaacacttctacatacacgcaccacaacctggtctctcatcacgcctgtaatcccagcattttggaaggccaaggcgggcggatcactgaaggtcaggaattcgagaccagcctgaccaacatggtgaaaccctgtctctgctaaacatacaaaattagctgggtgtggtggcgaatgcctgtaatcctagctatttgggaggctgaggcaggagaatcgctcgaacctgggagatggaggttgcagtgagctgagatcatgccattgcactccagcctgggcgagaaactctgtctcaaataaatacataaataaaagaaaaaaattaaataataataataataagaagaagaagcagccccaagaagccccatcctgcccacccccatcccattcacccctggaaggcagagatgcccttgaggactgtcccaagagcaaccccttgaaaggcccggggttgggggggtctttcagctagctactgagaggtggggaggtggcagggcctgtgcatctg

SEQ ID NO: 258913 - DNA, 2055 bp, Homo sapiens
ctcccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcaggtgaggaagcctgcaactgatctgggggtatggggcttgttagtcacgtgtcttaaccaacacttctacatacacgcaccacaacctggtctctcatcacgcctgtaatcccagcattttggaaggccaaggcgggcggatcactgaaggtcaggaattcgagaccagcctgaccaacatggtgaaaccctgtctctgctaaacatacaaaattagctgggtgtggtggcgaatgcctgtaatcctagctatttgggaggctgaggcaggagaatcgctcgaacctgggagatggaggttgcagtgagctgagatcatgccattgcactccagcctgggcgagaaactctgtctcaaataaatacataaataaaagaaaaaaattaaataataataataataagaagaagaagcagccccaagaagccccatcctgcccacccccatcccattcacccctggaaggcagagatgcccttgaggactgtcccaagagcaaccccttgaaaggcccggggttgggggggtctttcagctagctactgagaggtggggaggtggcagggcctgtgcatctg

SEQ ID NO: 258914 - DNA, 386 bp, Homo sapiens
tttttttttcttcaaagacacagggtcacattctgttgcccaggctaaaatgcagtggtacgatcatagctcaccataaccttgaactcctgcgctcaaacaatactcccatctcagcctcccaagcagctgggactacaggcatgtgtcactatgctcagctatttttcaaaaattttttgtagagacaaattcttgctatattgcccaggctggtcttgaactcttgggctcaagcaatcttcctgctttggcctccaaagtgctgggattacaggcatgagccattgtgcctggctgagattaataactttaaatgcttattttagaaaagaagaaaggtccagagttattcaaacttcctctttaagaagccagaaaaagag

SEQ ID NO: 258915 - DNA, 493 bp, Homo sapiens
ctactggtgtaaaaggatgagacttctgatggggcatcttgtgagggcaagaataaattttgcaagtggaaaaaatgttaataatccatgtccagagaatagagaggtagttttaaaatatggcccatattatttgaccctcttcctattgagaggtggggtctactcctctcctcttgaatctaggctctgtgactgattgatcaatagaatatggtggcaatgatgctatgctaagtttgaggctcaggccttaagaaaatggtagctttcacttcctatctcttgagaaacttgctctaggaacgcagccaccatggtatggcaaagcccaagttatcctttggcgagaaccaacaggcaacatgagttctgctagttatgtgaatggaattatcataagccccaattgaggtaccccaactgatgccatgtggcgcagagatgagctgtattcattttaatatagaatatattgatcttttcctttata

SEQ ID NO: 258916 - DNA, 667 bp, Homo sapiens
ggtggtgagggagggaggtggtgagggatgccacccttcgcctctgttgtgcacttgggacaagggacagcagaacaggagtcctcttctgcttttacttcctgcccagacctgcccgggccttgcctcttagcactcacggccttgggcaaggtgaatgtcactggggcttcatctctttcctctcccagtacaggggtggtgtactgaggtgtttcctccagcagtcttctgtggcaggcctgattctcttaggatgaatgtagtcatcctcgggtgggggggtcctacgtttctcctttagacggtcacgcggatgaagggaaatgtcaggttgctttgccttgggctggggtcctgcacagttgatggtcacagggttgtgagcccatgctggtcagaagcctatgattggtacatagggatttttttctatgaaaggaaaataggaaattaaatgattgcttaataaacacagcttgcttggtagaaacaaatctttttaaaaatggggttcctggggaaatatatgggagaaggcagcagcattgaggaggctcaaaattactgcttgagctctccgaatctccagggactgcgacctaataggtccttagtcagtagtcagcatttgctaagactgacagagaggatggtgccgtgcccc

SEQ ID NO: 258917 - DNA, 538 bp, Homo sapiens
cttcccagaatcagcaggcttcccaacacagctctaaatgcccagtttcaaccctcggcttcagtcaacagactaacaatgaatcggaagaaaaacagtcaacaaaaggatccatgatgaggaccatcataaaagaatggctgaggcctggctcctttctcagccactgtgttgggattcccagcctctggcctttgcgctcacctgggcaggagcctcatctgagcacagtggcagagcacagcgaggcatgggggctgccacaccgatgtgcacccatacccaggcttgagtgtgcaggctgcatgtcacctcccacacatggtgacttcagagcccctttgaggaggagggacagcggatgggaggaaataccacagggcttttgtgatgttgacagtgctctgtttcttcacctggctggtagtgacactggtctttgttttccaataagttgttaaggtatacgtttttgttgtatacttctttgtatatatattctctttcataattaaaaaaaaagataaaaacatttaaa

SEQ ID NO: 258918 - DNA, 770 bp, Homo sapiens
taggtaaccacaggaaccaggccatctgccttagataaataaattatattatgttacatggggcattcttttttaatattaaagaacattcttcattcaagttttgagaattatttcttacagggttattgattagcctgtggcacaatgaaaagattttctccaagcttaagtaccaaaaaggctttatacacaagaggtctttcaaaacttttttttttttttttttgagatggagtctccctctgtcacccaggctggagtgcagtggtgcagtctcgactcattgcaccctccatctttggggttcaagtgattctcctgcctcaggctctcaagtagctgggattacaggcatgcaccaccaggcccagctaatttttgtatttttagtagagacggggtttcaccatgttggccaggctggtcttgaactcctgacctcaggtgatccacccaccttggcctcttgaagtgctgggattatagacgtgagccactgtgcctggcctaaaagattatttagagaaaaattatccaattatgagggaataataaaatcatgatgtgtccacagaattatgcatatgttttaaatgtttcaaagtatttatattgattggagaaatgcttaaaagttaaaaaaaaaggcaggatactaatacagttatctgaaaagcatagaaaagttactagaagaaaatgcattcatatatatatgagggagtcttgcaccgtcacctgggctggagtgcagtggcgcagtctcg

SEQ ID NO: 258919 - DNA, 1054 bp, Homo sapiens
ccgcccctcaaccaacccccaggcggcaaggccctctccacgcgcgctctccagcctggcggggccctggaagccgggacacgcggaggccgggagggtcatcggcgtttaaggcagcctcccacaccaagtgcaccgcccggatcccctctgcacgagggctttctgcttattgctcttttccccagcagccagaatcgtcaccgtagcgcgggaaggggcctcgcgggccgtctgcagcaggtgcggccgggagccgcaggcccgcgcggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcaagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaaggtaatttctctactgtggtaaactttgtatcaattatgggctctgcccattaaggggaggaaagcatatgttaacttttattcaattatttggaaatttaggtgggtaaaaacatgaagctaatagttaagaacatctgttaaaagaataacttcaaggacatttcttcaatttacccatctcttattaccatgtggattaattatggaaatattttgcttatatagtcatagaaagttattctactttaaaaaatttactgccaacagcatgtcaattcagtgatctttatgggataggctgtcatgaaacatcaaaactttcaactactattaaaaattatatgaagaaaa

SEQ ID NO: 258920 - DNA, 819 bp, Homo sapiens
ccgcccctcaaccaacccccaggcggcaaggccctctccacgcgcgctctccagcctggcggggccctggaagccgggacacgcggaggccgggagggtcatcggcgtttaaggcagcctcccacaccaagtgcaccgcccggatcccctctgcacgagggctttctgcttattgctcttttccccagcagccagaatcgtcaccgtagcgcgggaaggggcctcgcgggccgtctgcagcaggtgcggccgggagccgcaggcccgcgcggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcat

SEQ ID NO: 258921 - DNA, 739 bp, Homo sapiens
cctgcagcccagtcgccgccgccagcggagcggcccgggcgggacgcggcgggagcgcgcgtgtgcgggacgcagcgcgggggatgcgcgcgggccgcggaggcgccgcaaccaacaggcggccgagggtgcagccgcgggagcgccaccgccagtggggtggggggcaaagctataaagaaggcccagaggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcat

SEQ ID NO: 258922 - DNA, 909 bp, Homo sapiens
ccgcccctcaaccaacccccaggcggcaaggccctctccacgcgcgctctccagcctggcggggccctggaagccgggacacgcggaggccgggagggtcatcggcgtttaaggcagcctcccacaccaagtgcaccgcccggatcccctctgcacgagggctttctgcttattgctcttttccccagcagccagaatcgtcaccgtagcgcgggaaggggcctcgcgggccgtctgcagcaggtgcggccgggagccgcaggcccgcgcggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcaagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaagattaagagaagagttatagagcaacaatccattaatacgaacttggatcgtgaagtctgtgaagtctgagcagagtgtttcctgtggcctctgtcagcggtttcctgcctgccataagtacaaggaactgttcatgggattgtactcgtggctttgtttctgttggaaatgtgttttattttctttataaaataatgggtaatcttta

SEQ ID NO: 258923 - DNA, 368 bp, Homo sapiens
gtacaggacatttccataacccccatcattctctcatgatcctttgcaacattcttctccctgaccccatctgcccctggcaaacactggtctactttctgttgtcatagattagttttgtcttttttagaatttcatataaatggaatcacacagtttatacttttttatatttgctgctatcattcagcatcatggttttaagattcatttatgttgttctacattatcggtagtccatttttatttttaaattccattgtatgaatatatcacaaattgtttattcatgcgcctattgttcgcatttgggtcgtttccagtttttggctgtgacaaataaagctgctatgaacttttgagtctga

SEQ ID NO: 258924 - DNA, 479 bp, Homo sapiens
caaacattggtctgaaagttcaggacacactgggctaggctacggtgagaggatggacaaccgttaggtgagagtaaacgcggaaggagtcacactggttatttttcccaatcaggttggtccaacttatgcaaaacaggagcaggtaagaaacctggatgtgagggatgggtgaggagaggaagaagcaaaagaataaaaagggagaccctgaagaaagcctgtgccatctgacatgaaaccaaaaaccacagctactacttagaaaggtacagcataggcctgttctgagtgaggactgaagggcctctttgacccttaccaggacttagaacccaaaccagtattcttatgagtatctggtaggtttgatttttaccttggactttttccaataacacgaaaaggttaggaaacagagagctatccctccctcccctggcggggagcaggaaacaaaggaaggaggatgacaggca

SEQ ID NO: 258925 - DNA, 442 bp, Homo sapiens
gattaggtgtttaccctgtttgttctcatagcacctcgtgcttgctctgtcatactatgttataatcctgtgcttactagtttttcttcctctctgaattgtaagctcttcgagagcaagggctaaattttaccagctttttgtctagcacctggcctcatagtaaatgctaaatatttcctgagtgaatgttgaatcaatgatttcagctgtgtttttttgtgtaccctcttctttttatagatctatctataataccaaattgaatggtctttttctcagcattcatatctaaatcacgttagataattgagagattatggtattgtggtggtttaaatatacataataaaatactacttttaaattgttttcctccaatcttaaaccatgtactatttcctgcttctcaaatgaatcaattcattttgaaacctggttg

SEQ ID NO: 258926 - DNA, 435 bp, Homo sapiens
ttatacctaatggttgtttgaggtaagtgaggaggagaggtgaagaaaaggtttactatttatcacatttttcatagcaaagaataagtagatattgccttaattgatacattttaaaaattgtcatttaagtataatatttaagttcagaaaggcaatgaccagaactaaggaaaaatgtatctaaagacataaaggaggagggaagaggagatatgatagatagtgcaagattcctaaacacttaattgtctggatagtgtctaaaggtgatgaatcatttaatagagtatttgggaaaaatataattcctttatagaggtacaaaaattaacaggtattaagtaactttctgttagtgttgaccagtcttaaagtttcagacaaacgaatgacatcatttagagctagatatggaacacagaacacagagtg

SEQ ID NO: 258927 - DNA, 478 bp, Homo sapiens
ggaatctctctaaaattgacctcattggttttgttctcagcaaactgatctgggccattcaacatagtttttattgtgcctggtgttgatgcctgttctctttttacaatacattcatgaccattggatgatatcaatttgacatacatggcatcagggacttcatagccaccataggttttctcctctccatccattttgttcttatgaaatcctcctttgcttcccaaggaacttgagaagtttttcattagccccacagccaccatagccgggtccccatgtactgccatagccccattccagggctgccccctgacccggctgcctgcccccatgggttccagggcagtcccttcctttttaatgctgaatgatattctattgtatgaatacatcatattttgtttatccattcatcagttgatggacattgagttattttcacttttggctattatgaatattgccagactgc

SEQ ID NO: 258928 - DNA, 332 bp, Homo sapiens
catgtggctgtagaactgtggtcccccatttctttgctggctctctctctctctacctcttagtaccatcctggtagtaaatgccattaatgtatttgacaagaagtctgtcattagcatgcttcccaggagatttgattagattgtgtctttctggaagtgacactagcaggagaaaatcaattgcaagcctgctgttaatgcttccttcccaggtttatgtctcttagagccctttcctgaaacgtggaaataaattttatcatctccaaatatatttaaatcagcctgttatctgtagaagctcccctctttttattcttggtttgtta

SEQ ID NO: 258929 - DNA, 300 bp, Homo sapiens
gctaatggctctgaaggttgttaacgttaatggattagaactggaggcgtgttaaactcagtgatttcaggtagcaggggaattaaataaaagattttctaggctctggctggaatttcagagttcaaatcacattaatactatttgatcaaatctactgaaagaacaatccaagcacaaatcctgtcgttgccctcggcccccaggattcactggctggttgactcatcttatctgtgtttaaataggtttagatttgggtaacgctgattaaaattcagattgatgttttcaaattta

SEQ ID NO: 258930 - DNA, 783 bp, Homo sapiens
tgctcctgctccaccaccacaaccaccatggttctcatattcacttaaatttgaatcctactgctcttggagtagacatttaagaaaccactaagttagactgagtatgtatgcatactgtacaattcaaaagtattaactgaatactattgtgctgtaaagaacataaaaggaaggatatatacgatcaatgccttcaaaacacaatttactaggggagataggataaaacatctaattataatactcaccaaatttagagacatgtagtaatagaagcagcaaggattacttctacttaaggggatcaggaaagattagtgaagaaggtgacatttacatcaagctctgaggcatgcagaaggaaaggtgtgcattctaggcagaggaagccccaggagcaacagcaaagaccttggcaatgactggcatgtgtgtggcaaatgtcggagaactaagaggaagagatgaagccaaaaagtaaactgcggctatgacagtccttgaattccaactgcaggaattctggctttattctgttattaaaaggagggaatggttattgaaggtttctgaacagtggatgacatggttacccttgagaaatattacgtcagcaatgtgaaaggaaagactaaggtgaaagacagttgggggctgtggcaacagtccatgtaatagataacaaaaagctcatctgtggagcagcagtggaggcacagaagagggaatctgaagtatactagaaagttttagatttgctgcatggtccaatttatttcc

SEQ ID NO: 258931 - DNA, 496 bp, Homo sapiens
ttcagtctagcccagcatcacttctactggattctgttggtgacagcaaatcacagggttggcccaaattcagtgtggaaggattccacacaaggttcagaaaaaccaggacacgtggctctttgggaccagtggttttaggcaatgcagagcgctacagaaaataaccatgaagaaatctgtaactttatatggattaaaatcatttctggacaggtgcagtggctcacgcctgtaatcccagcactttgggaggctgaggcgggtggattgcttgagcccaggagttcaagaccagcctgggcaacatggcaaaaccccatctctactaaaaatacaaaaaattagccgagtatggtggtgcatgcctgtagccccagccactcaggaggccgaggtgggagaatcacctgagctcagtaagtcaaggttgcatgatccaagatggcaccactatactccagcctgggccacgggagtaaagacctccgtctca

SEQ ID NO: 258932 - DNA, 593 bp, Homo sapiens
gaggcattgggccctgggatctcttgccagggagacaacccccctgcaactttgtgctaggtaatcttctgtcccctcttgtgtctcttctttccagtctggaccttcaaattggagggggtgaggagaaccctaaagcccaggcatcgatggggaattctggagacaaaagctaattaaagttcatttcaaacctgtggggagaaaaattctagacataaacctaatgtaaagaaacacataaaattttattggaagacaaaagaaaagtggaatgagcacacatatcatatttttggatggtaagaataaaaattgtgaaagtgtcaatttttttctaaatcatctattaattcaatgcaacctcatgaaaaattacaaagggattgttttagtccattttatgttgctataacaacaccacagactgggtaatttataataagcagaaatttgtttggctcatagttctggaggctgggaagtccaagagcatggtgccagcatttggtgagagccttggtgctgcatcatcccatggcaggagttgataggacaagagagagggctagagtaagacagggaaggtgatc

SEQ ID NO: 258933 - DNA, 661 bp, Homo sapiens
ctctgcctccacacagcctgcaagcagcagctggtgcccagcgtgcaaatgtatcactaccagcaccagaggttaacagatactacagctggagctgcagaaagagcctcctgaggagctggactctgcagatgagaatgaaagcagtgactttatggtgtacagtctggaccttcaaattggagggggtgaggagaaccctaaagcccaggcatcgatggggaattctggagacaaaagctaattaaagttcatttcaaacctgtggggagaaaaattctagacataaacctaatgtaaagaaacacataaaattttattggaagacaaaagaaaagtggaatgagcacacatatcatatttttggatggtaagaataaaaattgtgaaagtgtcaatttttttctaaatcatctattaattcaatgcaacctcatgaaaaattacaaagggattgttttagtccattttatgttgctataacaacaccacagactgggtaatttataataagcagaaatttgtttggctcatagttctggaggctgggaagtccaagagcatggtgccagcatttggtgagagccttggtgctgcatcatcccatggcaggagttgataggacaagagagagggctagagtaagacagggaaggtgatc

SEQ ID NO: 258934 - DNA, 492 bp, Homo sapiens
aattccaccctgacttccaccaacaaagacaggtaccatcttagttcactactcatctattttgttagtgagggaaacaagactaggatgtatgtttgtacttttaaacatttatattaccctccttggtctacaaacaatttgaggtggcatgtgcacacacatacacaaatacaaacagtccagggaaaaggaggatagaaaaagaataaagatagaaataggagtgtttatatacatgtatgactatgcatcttggcttaggtaaagggttcaataaaagggatagatacatgccgtatgtttgagagagtttaggtctatgcttctcaaactagggtaaggtcagtgtgccagagggtaggtgaaactataggacaaacattatttgccttcccagagcattactttttcctgaatatttggaattttttttcaaaaattatatgtaaataatcatttaaaaatggaatgcaaaatttcatacttgtt

SEQ ID NO: 258935 - DNA, 2869 bp, Homo sapiens
  misc_feature (523)..(523): n is a, c, g, or t
  misc_feature (579)..(580): n is a, c, g, or t
  misc_feature (589)..(589): n is a, c, g, or t
  misc_feature (592)..(592): n is a, c, g, or t
  misc_feature (1338)..(1338): n is a, c, g, or t
  misc_feature (1341)..(1341): n is a, c, g, or t
gatgttagcctgtaaaatgaactacaggaatagctacagattggaaacaacctgtggtggttttaaaatatagctacaaattctttagcactcctctgtagagaggtgggatccttgtaccctctctgaatcttgggtgagctgatgactgcttcaaccaatggagtacggtggaagtaacactctgacttctaaggtccagacataaaagtacaggcaacttctgctagaactctagctcttggagcctgaggcaccatgcctacctagggctccatgtctgcttagaggctgccatgctgtcaggatgccaagaccatcaggagaggacacatgaaggcaccacagtcccagctaagcttagctttgagtcatcccagttcaagcataaaagaagtgagtgaagaagaaccagatgaggccaggcacggtggctcacacctgtaatcccagcactttgggaggccaaggcgggtggataccctgagttcaggagttcgagaccagcctggccacatggcanaaccccgtctctactaaaaatacaaaaatagccgggcatggtggcgtgcacctgtnntcccagctnctngggaggatgaggcaggagaattgcttgaacccgggaggcagaggttgcagtgagccgacatcatgccattgcactgtagaaggcgaaggggaaggggaagaacaagatgattccagtggccagccatttgaatcagcttcagccttcaaatcttcaaatcttcctagctgaagactcaaacattgcagagtagaaacaagctggcctcactgtgtcctgcctgaattcctgacacacagaacccacaagcatattcaagtggttattgtgttataccactaggtttggggggttttgttctgtgctaacagataactgggacaccacttaaatatccatcaatggaagacgagttatgtacattatatgtctttgtggaatactatgcatccattagaaagaagaaattagtctataattatttatattaatcacacttcaagtgaagaaggatgcagtgttctgaaaagtcttgatagtatgcctccatttgaaattctcaaaaagatggcacatatagagaacttctgggaaaatagacaagaaagaggtaacagtagatgccttgggggagggtaactgatggcaagggtgggaatgaaattcactttttttttttttttttgagatggagtctcgctctgtcaccaggctggagggcagtggtgcgatctcagctcactgcaacctccgcctcccgggttcaagcgattctcctgcctcagcctccccagtagctgggactncangcacatgccaccatgcccagctaatttttttttgtatttttacactttgggaggctgaggcaggtggatcacaaggtcaggagtttgagaccagcctgaccaacatggtgaaaccctgtctctactaaaaatacaaaaatcagccgggtgtggtggcatgcacctgtagtcccagctactccggaggctgaggcaggagaatcacttgaagctgggaggcggaggttgcagtgagccaagatcgtgccactgcaccgtagcctgggtgataagagtgagactctgtctcaaaaaaaaaaaaaaaaaaaaaaaaaaaaaaaaagggcagtggatgtagagctggcaaaaacaatgacattgagatgaagcgtgctcaggtcagagctctaacgaagccctctgctgcagactgaatgtttgtatctccctcatattcatatgttgaagtcctaaggtgatgttatttggaagtgggcctttgggagggattacagcctgataagaggagacttgagagcttgcttcttctctgtgccatttggggctacaataggatggtcgtctgtacaccagaagtcaggcccttggttgccagcagaatggaatttgccagcaccttgatcttagactcttcaccctgcagacctgaggaataaatgtgtgttgtcaagccacctgctccatgctaaattgttatagtagcccaagcagattaagatgcctctgtttggctgtctatggctgcataacagaccactccaaatccaatgatttttatcatctttcacaatttctgtgggtcaggaatttgggaagggctcatctgggtggttctgccttggtgtctcttttgtggttacagtggaagccggagcactggggagctggagcagctgggagctggccaagcatctctcttcatatagcctcaaggcctctccatgttgtctctctgcatgagccagttgggcttcctcacagcatggcagctgagagtgttgacacctcttacactgtagctcaggactcccatgagtcaggccacattgcctttatgacccagcctcacaagtcaccatagaatcatttctactgtagtctgagtcactaagtttggctcagattcaaggggaagaaacagactctgttactcagtgggaggagtcttaaagaatttatagacatggttgggcacgatggctgaagtctgtaatcctagcactttgggaggccaagatgggaggatcgcttgagcccaggagctcgagaccagcttggtcaacacagggagcccctatctctccaaaaaacttaaaagttaaaaaaaattagctgagcatggtggcacgcacctgatcgcaccactgtatccagctcgggcaacaaagtgagactctatctcaaaaaaaaaaaaaaaaattatggacatgttttaaaaccaccatactacatttgaagaggtcagaggaggagaaagaaccacagaagcatctagagagatagcgggtggtggtgggtgggggcaaga

SEQ ID NO: 258936 - DNA, 2866 bp, Homo sapiens
  misc_feature (523)..(523): n is a, c, g, or t
  misc_feature (579)..(580): n is a, c, g, or t
  misc_feature (589)..(589): n is a, c, g, or t
  misc_feature (592)..(592): n is a, c, g, or t
  misc_feature (1338)..(1338): n is a, c, g, or t
  misc_feature (1341)..(1341): n is a, c, g, or t
gatgttagcctgtaaaatgaactacaggaatagctacagattggaaacaacctgtggtggttttaaaatatagctacaaattctttagcactcctctgtagagaggtgggatccttgtaccctctctgaatcttgggtgagctgatgactgcttcaaccaatggagtacggtggaagtaacactctgacttctaaggtccagacataaaagtacaggcaacttctgctagaactctagctcttggagcctgaggcaccatgcctacctagggctccatgtctgcttagaggctgccatgctgtcaggatgccaagaccatcaggagaggacacatgaaggcaccacagtcccagctaagcttagctttgagtcatcccagttcaagcataaaagaagtgagtgaagaagaaccagatgaggccaggcacggtggctcacacctgtaatcccagcactttgggaggccaaggcgggtggataccctgagttcaggagttcgagaccagcctggccacatggcanaaccccgtctctactaaaaatacaaaaatagccgggcatggtggcgtgcacctgtnntcccagctnctngggaggatgaggcaggagaattgcttgaacccgggaggcagaggttgcagtgagccgacatcatgccattgcactgtagaaggcgaaggggaaggggaagaacaagatgattccagtggccagccatttgaatcagcttcagccttcaaatcttcaaatcttcctagctgaagactcaaacattgcagagtagaaacaagctggcctcactgtgtcctgcctgaattcctgacacacagaacccacaagcatattcaagtggttattgtgttataccactaggtttggggggttttgttctgtgctaacagataactgggacaccacttaaatatccatcaatggaagacgagttatgtacattatatgtctttgtggaatactatgcatccattagaaagaagaaattagtctataattatttatattaatcacacttcaagtgaagaaggatgcagtgttctgaaaagtcttgatagtatgcctccatttgaaattctcaaaaagatggcacatatagagaacttctgggaaaatagacaagaaagaggtaacagtagatgccttgggggagggtaactgatggcaagggtgggaatgaaattcactttttttttttttttttgagatggagtctcgctctgtcaccaggctggagggcagtggtgcgatctcagctcactgcaacctccgcctcccgggttcaagcgattctcctgcctcagcctccccagtagctgggactncangcacatgccaccatgcccagctaatttttttttgtatttttacactttgggaggctgaggcaggtggatcacaaggtcaggagtttgagaccagcctgaccaacatggtgaaaccctgtctctactaaaaatacaaaaatcagccgggtgtggtggcatgcacctgtagtcccagctactccggaggctgaggcaggagaatcacttgaagctgggaggcggaggttgcagtgagccaagatcgtgccactgcaccgtagcctgggtgataagagtgagactctgtctcaaaaaaaaaaaaaaaaaaaaaaaaaaaaaaaaagggcagtggatgtagagctggcaaaaacaatgacattgagatgaagcgtgctcaggtcagagctctaacgaagccctctgctgcagactgaatgtttgtatctccctcatattcatatgttgaagtcctaaggtgatgttatttggaagtgggcctttgggagggattacagcctgataagaggagacttgagagcttgcttcttctctgtgccatttggggctacaataggatggtcgtctgtacaccagaagtcaggcccttggttgccagcagaatggaatttgccagcaccttgatcttagactcttcaccctgcagacctgaggaataaatgtgtgttgtcaagccacctgctccatgctaaattgttatagtagcccaagcagattaagatgcctctgtttggctgtctatggctgcataacagaccactccaaatccaatgatttttatcatctttcacaatttctgtgggtcaggaatttgggaagggctcatctgggtggttctgccttggtgtctcttttgtggttacagtggaagccggagcactggggagctggagcagctgggagctggccaagcatctctcttcatatagcctcaaggcctctccatgttgtctctctgcatgagccagttgggcttcctcacagcatggcagctgagagtgttgacacctcttacactgtagctcaggactcccatgagtcaggccacattgcctttatgacccagcctcacaagtcaccatagaatcatttctactgtagtctgagtcactaagtttggctcagattcaaggggaagaaacagactctgttactcagtgggaggagtcttaaagaatttatagacatggttggtctctttggctggggggggggggggggaggggggggggtggcagatttttttatccttggcccaggagctcgagaccagcttggtcaacacagggagcccctatctctccaaaaaacttaaaagttaaaaaaaattagctgagcatggtggcacgcacctgatcgcaccactgtatccagctcgggcaacaaagtgagactctatctcaaaaaaaaaaaaaaaaattatggacatgttttaaaaccaccatactacatttgaagaggtcagaggaggagaaagaaccacagaagcatctagagagatagcgggtggtggtgggtgggggcaaga

SEQ ID NO: 258937 - DNA, 354 bp, Homo sapiens
gagattacaggcgtgagccatcacgcccagcccagggttatcttttaaaaggcaaatctgatattattacttcttggtttaataattataatgctcctttccttttaggatcaggtctacacttctcaagctctactactaaaccatcagccattcctccaatcatgtcctacaacctcatgcctctctgtgcttgcacagactccctgctactatgaattttcaaaattcattagagagatcatttattttctcctcagtctgaattgtatgctaagccagtgggcactccctcaacagcccacacttacatctgtaatagcacctagcatccaacattaagattctcactat

SEQ ID NO: 258938 - DNA, 152 bp, Homo sapiens
gagattacaggcgtgagccatcacgcccagcccagggttatcttttaaaaggcaaatctgatattattacttcttggtttaataattataatgctcctttccattatacaaagatcacctgggcatagtcatagagcctactcatgcgcgtg

SEQ ID NO: 258939 - DNA, 413 bp, Homo sapiens
ttttagttttaatgcctctgtaagtagacattctttatataaggcttctagaagtcagtttttctcatcagatataaagtcgagatggggcaatatttttagtgttattgatatttgatattgatattccccactgcaatatttgtttcattcttgttcactaaaaaagtgttgactttgtttataaaagttatgccttttctcaagtaacatctgtgaacagttattctaaaggctatacatcgtataaatgcatgtggttacgtattctctaatgaactagcgattgtttaactagctttactgaggaatgattaagaaaaaagaagatacaagttaatgtaaatatgaaatttatcttgaaaaagattacttttggcactaaccaggctgttaaggatttcttttgtagt

SEQ ID NO: 258940 - DNA, 300 bp, Homo sapiens
aaaaatgatttcaatattaggtacctaaagtagtcaaatatatagagacagaaagtagaatggtggttcccaggagctggaggagggaatgggaagttaccgtttaatagatataaaatttcagtttgggaagatgaaaaatgttctgaagatggatggtggtgatattataccaaatgaatgtaattaatgctgctgaactgtacacttaagatggttaaaatggtggattttatgtgtattttactacaataaaaattatttcgaagattttttaaaaataaaagacgcttttgatat

SEQ ID NO: 258941 - DNA, 288 bp, Homo sapiens
gacagcccagtcttcaatgtccaaggccatcacttctgcatcaaaatcaggagcccctagaagccacacacagctccagcaatcccattttactgatagggaagtggaggcaccaagagacacagggcccggcccaggatagagtccagatctcccagagcccagtccagcactgcctggcaccaactcagctggtctgtttggacaccttgggaccataggaggagagctgaccaccaagagagttaaagaccatagggtcttggagatcagagggggagagcagta

SEQ ID NO: 258942 - DNA, 284 bp, Homo sapiens
gtgggtctggctgtcctgccccgggcaggggcccttgagggcagcagagccttctcttcagctagagcatcgcaggcctgcaccctcgctctgtcgcttcttcctgcgtgaccttgggtggtccagacactgtcctgggctttattcgggggaggcctgcctgctcagctcccaccagccctttgtgaccccgtgtcctcaggcagggatcaagttcatgcccactgacctcagcctctctctcgggctgtctcctccagctcagggcaggccagatgcaggac

SEQ ID NO: 258943 - DNA, 369 bp, Homo sapiens
cttccacgctctcctggctgttgaatgttttccactgaaggagtctagtctgtccacctagggggctctccctccctcggtccagggcattcgcggctcacaggtcagctcgggcagaaccgccctgaccacctatgagctcctcgggacaccaccccaatgccagggtgaatcgtccttacaccctcagtcctgtccgagcggcctgatcctacctgtttcccagaaactgctacgcgaagcttccccgccgggctcatccagggcggaggggtctgtccctgacgcagactgggggcgggtccgcaaaagcgggctgaatgaatgaacgcagcagggctggggccccctggggctacaggcccctgc

SEQ ID NO: 258944 - DNA, 541 bp, Homo sapiens
acattcatgccatgtttttgctgtttttgtcattttgagaatatactgcataaacaagcattttatacacacgatttaagaagtactctagtccatgcattgtgtttaaaatcttttattcatagaagtaataattgtcacatgaaaattctgggaccaaaataatatcacaaaatgctgattcttgaactttcacccatacaacatgtagttagaataaaaatcttttttaaatataagggaaacaaaagataaagattagcttatgtaaattgtatatacattaaagcacattcacgtttctttcctcatgggtttatcagtgttggtagtctttaagaaatgatagaattgcttaaaattttttcttttgctgctatacaggtgttttttgtatttggtatgattttgccatggtttaaccgtaattatcagcctaatctagtaaaatttgcctaatttctttctgtgaaaagataaattatgcctgagtacggagaacagattattttgtttcattaaatcttggtgtacattcatc

SEQ ID NO: 258945 - DNA, 743 bp, Homo sapiens
gtccaacgttgcctcgcggaggccgccgtgcggagcaaatgtctaacggaaatcagaggtggaaaagaggttggaggagcctgttccgttccacccgcgtttactgatgcgcccaccagcagccacgcttggggctgggggctttgaggacacgcacgtgagtcagggtcttctggcctctaaggcacgcgcaggaagaaccctagatagacggaattacgacccatatcggaagaatagcataaagggcgacaaggctcaaatgagctagaggacatcgggtggggaacctggaagggacttcaaagaggcggtgtggggagtcttcaggctcactctgaggtccccattgtggcttgcttctgcagctgagctggatttgtgtaaagtcaaacctcagaacagcgagcatgagtagagagtctcaaatgatatgcgactcttcaactcacactttggccgaagagacttttggaaagaaccatgaggttcaagttattcttcatgcatttgtgcttcctttccaggccttgggctgagctgattctcagctttatttgctggcgtggtgcaaatagtcaaggtgttacttccagccctttggggtgtaggttcacctcctttttccaccttacctgtccctagatcttctgtttccaaggccaagtctttaaagggttttcagtccctctagcaaagtaatgggtagggaggctcatcgtgagggaccacattttccctac

SEQ ID NO: 258946 - DNA, 526 bp, Homo sapiens
gtccaacgttgcctcgcggaggccgccgtgcggagcaaatgtctaacggaaatcagaggtggaaaagaggttggaggagcctgttccgttccacccgcgtttactgatgcgcccaccagcagccacgcttggggctgggggctttgaggacacgcacgctgccttaaatataatggacatccgtatggattaagactctatacaagctttctctttagtacaccaggggaaagtgaaaaaagaaccacatttgaattcggctttgtcactacaagtgggtgaccatgagcaagttactaacctcagtgaacctgttcctaacctaaaaaggaggagaatggagagcaggtaataataccttatgagatggttgtgagagttatatagcattctttatgtcatagtcctagcaaagtgctggcataaaataggtgctccctaaatgttaattacctaccttcctttccctttctgtcagattttctctactattcttatgaaataataaagagtttttgtaattaaa

SEQ ID NO: 258947 - DNA, 203 bp, Homo sapiens
ctcacggttttctccatccacccaaggaaaatgccctcagagattcaaacctaaagctccttttttttttttaaggcagagtctcgctcctgtcacccaggctggagtgcagtggtgcgatctcagctcaccgcaacctccgcctcctgggctgaggcaggagaatggcgtgaacctgggaggtggagctttcggtgagccaa

SEQ ID NO: 258948 - DNA, 419 bp, Homo sapiens
aataaattctccccttttgaaacaagttatagtcctttggagatattcatatataagcaagtagatatagatacacacttttttgcttttgtagacaaatgataacacattgttgacccatctcttgtcttgccttttctactttccagtccgtcatgaagatcattctgtactggtgcataaagtgcttccttattcttttttatagctgcataattttccactgtggaaataccttgacttatctagtcattcctctactaaggggcatttaggctgttcccagtctaatggtacaggccaggtggggtggcacacacctgtaattccagctacttgggaggctgaggcaggagaattgcttgaacccaggaggtggaggttgcagtgagcggagatcgcaccactgcactccagcc

SEQ ID NO: 258949 - DNA, 526 bp, Homo sapiens
cagaagggatgaaatgacagaggctggcagagtgtgatgataaatgacagtgactcgtggcctgggaatgggtgggatctttggaaaattggaaagtctatcccacctaagcaaccctccctggcagtgctactcagttccacctccaagaaggaggtttccaattttttttccatgacaagccagaagttctgatttttagtttgttttctgatttaaaaaaaatattggcaatagtgcgtgagccactgtgccaggccaatgtcaggcatttagtagctgcctcacagatgtgagaaaaatcctgtgtaggtcatccagaaaattagaggaagaaataggcttagaacttttctctcatgactcccagtgcagagcttgttccacattacatgggcctactttcatgggagtttccagaggtgtctggacacaggggtccttcttaactctgggaaattgtaggttattttatgagagcctttttccctccagcctgggtgacagagtgagactccatctcagg

SEQ ID NO: 258950 - DNA, 497 bp, Homo sapiens
aggggagagggagggaaatcaaactgagaaataccacaatgcagaccaaattccatctgtcatgtgttccttcattaaaaaaattaaaatatctgaatcaagcataatagcatattgttagctctggggtggacacagaatttgttgtattggtctctgtactttagtgcatttattttaaaaattcatgataaaaggatgccttttctatatcttgcccattcaaataaccctcctacccatcagtccctaggaaagtccataagtagatcagtcaggtgaggcctgatcaagtggttctgatgataatgccaaggactccatttccttttgttattcccctctgcctcccttgttgtctgattcatcttgaggatccctaccacgttctctgaacagctccagttgtttccctcataattgcaaatgactgtggcacctgcaagcctcacattctcgtgtcatgctttccaggggacaagcgggtgtctctccaa

SEQ ID NO: 258951 - DNA, 368 bp, Homo sapiens
agaatttatctaagttttggtcataatccttgctgatagctatttagatcacacatgatctgttttcagaggctgtatatcccctagggaggaataaattagtacctagaatctgtaatcagagataaagaggcggggggagactggatggaagaagtcagcagtgaaactccagagcttattcaccttccatgttctcatttctgaaattccgtggaagtgtatctagtgctccagtgcttgatgcttctaggtcatttttcaaaactggtctgctaaagtaggtcagttttccaagaaccacagtcacctgaaaagagcagttagcttgccatcagatcaccaatcccattgccagactatagatt

SEQ ID NO: 258952 - DNA, 1053 bp, Homo sapiens
tgggtctcctcgaacagtagaccatgatacgattgagctcgtaccctgaacttcccgggcttcagcaccataccggacatccagcatctgagatgagttaaaacgcacagctggaggtgactttcgagatgagggtacacttacaacatacaagttgtttatggcgctgggacctgaggtatctagtccgcatatacagtgacacgtatgcatttactgccacaaagatgggtaaaagtcaggagaacgcacttaagagcccaagcgacatacttaatgtctgcttgtctaggagagcaggttgactcaggacttcaaatatgctgggatctggagccatagtaaagaacacatatgcttgcctaaaacccagggataccttccacagcaggagcagcacatcaagatgggacgatcatatttaaaaacgacggttaaggtgcaacctaaagtaaatctcacatcttggcaatcgtgtgcaaaactgcgcgcctgacatccctattgcacagggaagcccatctagtacttgcactgaggtttaaaaccttggggtgcatgtctgaggacccggaaagcacttttgaacaactagatgcgaatgctgcaggaaggggcgaaggcagtggagtgaaggggtacgtttaagttgtgggaggtgatctaagtctcggtatccatgtttatgaccccaggaagcctgtttaaggtttcagtagggctgccacagctctgtgccatccacaccgctgaggcagtgtatttaagaagcggacccgagcgcgaacccaggggaaatctcacatcggggcaagcgtgtgcacggtgcaaagtcgcgatgtgcggttttacagccccaggtaaaccttacggtttctgaaaagcatgtgcatcttttgggtccggagaagcgtgtgcagcccaaagtacctgcgaagctgaatgtttacgtttaaggtctgggctcacggcagtccatcaaagcatcccacatgtgggcgcgggcgcgtattctaggtgcgcactccacgggcacggagcggccgccagggg

SEQ ID NO: 258953 - DNA, 589 bp, Homo sapiens
gaatacaaattgttctaccaaaaatacacatgcacttttatgttcatcacagcactattcacaatagcaaagatacggaatcaacgtagatgcccatcagtggtggactggaaaaagaaaatgtggtatgtatataccatggaaaacaataaagtcattaaaaaacctgaaattatgtcttttgcagcaacatggatgcagctggaagtcattatcctagcgaattaacacaggaacagaaaaccaaatatctcatgttctcacttataagtggaagctaaacagtgaatacacatggatacaaagatggggaacaacagactccggagcctacttgaggtgggagggtgatggtcgaaaaactacctatcaggtaccatgctcactacctgggtgatcaaagcatttggacaccaaaccccagtgacatgcaatttacccatgtaacaaacctgcacatgtactcctgactctaaaataaaagatttaaaaaaatcaatagttctcgaaatttttggtctcaggacttaattacattgaggatcccaaggagttttttgtttatgtcagttatagctactaataattg

SEQ ID NO: 258954 - DNA, 670 bp, Homo sapiens
ttccctccagacagaaaacatgttaaggtgatcatacatcccctaagagtccctgtttgcctggggaagtcccactgtgtgtttattatacactcacgtttatttaacagtatcctcttgtgttctccaaggtgtcctggtttggagataaatgatgtggtcactcaaaatgaccaccgattgtgctgggagagtagaagttaattctcccagtagatctcactggcatgcaagcacacacagaagactctgtaccattacctgttctcaaccaatttccatctgtcagagattaaataataaagactgtaagcaaatgacatggcttacattaaggaccatgacctgctcttagcagggcaacatattgtctctgagtattcctatcctctctcgtctcccttactgaccttgccagccagagagccttttgttttgatgatgcctgagagcaggcaatgaagacttctggtttttctggtcctacatttacctcatttcatttagcttgattttaccttttgttcctcagctaaagcagcaaggatgactactggggcattatattgagcgctgatgcaatcaatactagtttcaagtaacacagaaaagcccccagacctacattagagctgtgagcagaagttttgattggcgtcaggtgctacat

SEQ ID NO: 258955 - DNA, 313 bp, Homo sapiens
aactttaaggttggtccaaagcaagatacatgatcaaatatttcatctgctattttatcctcagcatcagaattttaaaatcctttgttgcaagctagttagcctggtactctcctatctaggctgctagaagcatatacacagaaaattcatctttccctactctgtagcacctgtgttactctctattctctgaaagttttagatatgttgtaaatagtcatctcttagatttccttgtatttagaaaagttgttttttggtactacaacaaaaattgttgtttggttgtaattgttggtgagcacactgg

SEQ ID NO: 258956 - DNA, 989 bp, Homo sapiens
cagaccagaccacattgtgtcaccccacattccacctgtgcactcttccaggggtggcatccacaggctcatgccaatgcaggcatgttaggcaaaggcaaccaggtcaaaatcttagtgcctcagcctgagaattaattaacatttaatttcttaaatgacttgttttctggtttaaaaagaaatacattgtgcactaataaaatttagaaaatattaagcacaaagatgagggcaaaaatccattctaatccttccaaccagggaaaccacagtcaatattttggtatgtctaagtctgtattttttccctaataagtatgtatttttcttttgcttttttattacaaaagtgggattattgtatatgttacattttaccactttgtttttcaccttaaaacatttcagacatttgaaaatgatgttaaatattccatttaataccactttactggctgcttattattccctaatattccctggattcctgggaggcagtgtgcatattggttagcaccaggggattcaaacctccaaagaccctgaagtccaggctatctttcagctatgtgatctggggcgagttacttaacctttctaagcctcagtttcatcatctatatagtgggaatgatgcttataatgctaatgacccttctggtagttatgagtgttaaattatatgatgcatgtgcaaagtttgacaggtacccaataaatgtaatgttcatgattcccatttttgttcaaccagtgcttcattatcttacatcaaatttacccacttgatctggtatcattccagcactttaatggacatctttgtagctgtgtctttgtttatatccatgattgtttttaaggatttattcctgcaagtggaattttttggtttctaagggtatataatctgtaagttttccagatcagtatcagataacaaaaatatcaaataaaaaagaaatggattcctttctttctgcaaa

SEQ ID NO: 258957 - DNA, 509 bp, Homo sapiens
ggaaggcatttttctgcacttcccctcctcgggagctagtttttatttgtagatgaaattattctttctgtatgttggttttacttactatggaaatcgcataaggaaatactggattttattctgaccaggcagtttctgcctcatttttatcactggtgagcactgttagaaaaggtagcaaaccctttcatgaggctgaaaggctgtatctggcggctcagcccagggggaggggcgtgtcagccaacagccaggcagccttgagagacctgtcccctgctggcagagcagcatcacttccccacttcccactctcggtgtttgtgggggtctctgttcaggttatagctcttgatattaaaacgtctctagagttttgttcttttcctctctaatccacccaaattactaattccatcagcactgcatccagcagaagcccctcgggcagctccacctcaagctggataactggatgcatggcacgattaaaatttgttggctta

SEQ ID NO: 258958 - DNA, 195 bp, Homo sapiens
caagcagcaggtagccctgggaggccagttccccatgactgccccccaacaccgcttgggggaccctcatgtggtcatttccatcacaagaggaatgacccctgtgggactgggccagctgagcccgcatctctcatctctgcttatggatttgtttgtgtctagggatttaataaactcctttctcttccgttg

SEQ ID NO: 258959 - DNA, 353 bp, Homo sapiens
ggagagaggcagaatgccctgggagaaaagacttctccagcaggcctctctgctgataatcctgaagtgggtggccatcttgctggggtaaggttggggtggggggcaccggagccgctgcaggtagaggtgttgggggctgctcatgtgtttctctctcccacccctctggctgcctcagaaacaaggtcccagattcacccctacccctgccccagtgagttaatgtctccttgaaatggacactgcctgtcctggatccaggccagggggaatatagggcactggtggaggttaacccttgttcaaccacagaggagccaggccagtcctctccttccctcaggcgtgcc

SEQ ID NO: 258960 - DNA, 477 bp, Homo sapiens
caaggctatagaaattgcaatgatgatagaggccacagggaccctcctgtgagcagatggaggatctccaaagattacaagaatttaaccaacttgagtgatcagcctgttttacagcctcctgacctcaacctgttcttccccagccctgggtggaatgaggtcaccctgtttgtttaaatcagctcctaaatgaccccaggttacttacagatgaacccaagttaactctcctcattaccatgctaaagtcttcaccccgggagaagctatagcttcatgactataacctatgcaacctatgcgctagcatcatgactcactgggacccctactctacatgcaatcatgcaccctctcctttctccatcaccccataaaaccctcctgtctctttctctgggggacacactacttgggagaatatgcccagtgtcttcctttcttgtgccaagtaaaactcccattgatcaaaac

SEQ ID NO: 258961 - DNA, 731 bp, Homo sapiens
aattcgcggccgcgtcgaccgacagaaggggtctcaaaaaaaaaaaaaaaaaaggtaactaaaatgtaaaagcaataactatttattttaaaaaggtcagtattcaaggtatataatatttaatgccatttaaaaaataaaaattaatgccaaaaatccatgatgagcaaaatatcattaacattttaaattaagagaggaacagtactgatgattctgtctttgcctcaggctgcagtgtggcttagcagggcactgctctgaacttcttttttcaatttgctgctttctccgggaagccttcccttacctcagcctggttgagggccccctgggctgttttcactggttgatggtatctgatcccttccagcctgaggttcctggagggccagtccaggtctgaggtctggttcatgcttccagtgccttgaacatggctgttccgaggtgtcagtgccgagtcaccgtgtctttgatgttagccagatgcccttagtgcaggaataggaacttgagagaggcccagtagggagccaggcttttctcagggagataagtagtttcctgtttcccagacctggtcattccagtggggttgctgggaccgtcatctatcaatctgtgttaaacgcttagtacagtgcctggcctgtatatagcaggtgctcagtttttgcttttgtttttgagctggagcctgggcaacaaagcgagaccttccctgtctc

SEQ ID NO: 258962 - DNA, 372 bp, Homo sapiens
aaactgaggccctgggagattaagtaacttcccatctgctgtagtcagggtcgggcccttagtcaccgtggtctctggaacccacaggcctggaaacagcgcttttgagcaggggctcagcgaggctgggggtcagactagtggccgaggtgcgcctgtgtggagatctgagggtgacgtaagtagaggcactggcgtgagggcccctcatgcagtgtcaggcttgcacctttgcttggaaattccattagctttggaatttatagcttcgtggtgcagtgtggagttatgttggagataccacaaagataaagcatttccatggtgaacaaaaaagtttgcaaataaaagcagtccaggcagtttttgttt

SEQ ID NO: 258963 - DNA, 807 bp, Homo sapiens
agcatcccaggtgacttagctggagggaacctgctatggactgaattgtattcccctaaatttatatgtagaagctctaatccccagtgtgatggcgttaggaggtagggcctttgcagggtgattggatcatttgcatggaaccctcttgcataggattagtgcttctgtaagcagagacataagagagatgacttctttcctccacgtgagactatagcaaacaggcagctctctgtgacccaggaagccagccctccctagaacctgaccatgctggcaccctgatcttggacttctagcctcccctccagaacttcgaggaataaatgtttgttgtttgagccacccagtgtatggtatttgttatggcagcccaaactgagtgaaacagaaccttaggggttacctggtcaaaaccccccttgttcagatgatgagaggagagaggcccaggccatcaggcaggtgaggtctgtggccagcctcagactttagtttcctgatggcattaagaatctctgctctgagcctggaatgaatacaggctctacctgtttttagctgtgtgcaaattaccacgcactgtggtttcccatctatagaatggggctgtaagggacctggcctcacaggctctggggattagaggagatggagcaggcaaagcactgaatccactgaggtctcagtgctctcagtgattatcatcattgttgttgatacgcctgcttgccttatattctttttactgcacaaacgccttgttacatatggaaaataaatccacctgcttcagactctgat

SEQ ID NO: 258964 - DNA, 693 bp, Homo sapiens
catatttaagaatgattcttttttcctatagggctagtcaagtgaagcagtggaagtggagaaggaacaaagaaacctgtaactggttgtgatcaaatatttgtaaacaggaatgaatttttatgcactatacactgttatcaaagttacatatgctgcaaagctggtggtgaacagcagtgccctggtcccttcctacacttatctgtagggataacaatttttaatgcacgcaacccacctctacataaatatcgttactctttgactgtccaattttccatcccaggtcctgcagttctgcccgcaaggggaaacggagtttgtgtttccttacctgccagtccactccaaggagccaagaaggcgtcaacccccctcaaccccggctcgtcctccaaactgagcccctcaaagactgcggtatttttcagtccttcgtaaccgctctcagccccaaaatatgaaaatgagagcgatggtcctgagcgcctggagtgacatcttagttcgctcccaagacccatcaggaacctcatcccaagtgctctgaagagcaggagaaaacatttttaactaaggcgtcttctccttggggcagggtcctgacgggagaagggggagccccatcttcagagactcgcccctcagagctgctcaggttcctcttccccgtggccctgagggagctcg

SEQ ID NO: 258965 - DNA, 372 bp, Homo sapiens
agagggatatttttcttggaatgcaaaaatagttcaacatgcaaaaatcaaagtaatatatcacattaacagactgaaggaaaaaaaccccacatgatcatctcagttgatgtagaaaaagcatttgacaaaattcagtaacttttcatggaaaaaactctcaacaaactagaaatagaaggaaatttcctaacataataaagaccatatatgcaaagcccacagctaacatcatactaaatggtggaagattgaaatcttttcttctaatatcagaaacaaaacaaggtttcttagtttcaccatttctattcaatataattcttgaggtcctggccataagaattaagcaaaaaagaaataaagggcata

SEQ ID NO: 258966 - DNA, 450 bp, Homo sapiens
cagagtcagactgctattctagactggactccagtgcccatcccactgttgtatgctgttgtcaggaggaatttgcagggaggtggctttatctgctgctggagaactatgaggaccagactccaactcatgcagaggaaaggagcacttagcccatggcccaaactgaaccctctgtgtacccttctgaaaacctccacctccttctacttccctgggcagccctgggctttgccccacggcaccctgactgcacttagctaggctttctcccaacctggattgagacttccccaggactggccttgcaccctgtgggctatccggacacatgtgagggtgtcaaattttaacactatgtatgtatgttcatgtaactaaggaaaaaaatataattaatacatcaaacccatgatttcacagatcatagtgcttttgatgaggctaagt

SEQ ID NO: 258967 - DNA, 415 bp, Homo sapiens
atttcatatttaagccctactagccaggaacaaatatccccactttgcagagaaaattgaggtatagagaacaagtaatttgctcaagatctcagagcaaaaggtgacagagctgagatttgggtccaaggagtgtgctcttttgtcttaactctctcatcacactgtctctctgttaggaagaggaatctatgacatatggttgtatagatgtgcaattgctctcattcttgctatatattctttaccaaaatgccagcgactaagctgatgttaaaaatatagccacataatcacacacacacacacacacacacacgcaaataacaaactctcttttgagtttacataacaaaaataaaaataatttaaatgatcagtttaaatatgtaaacacaacctaaaaatgaaagtt

SEQ ID NO: 258968 - DNA, 580 bp, Homo sapiens
tcatatttcaggggcttaatacccgcatgtggctaacgtactggtcagcacaggtctaagctagaggtctaggtctggagaccagaaacattggcatcacctgggagctttttagacctgcacattctcggctcttctccctctcccccgcaacctgctgaatcagactacattttaacaatagcctcaggtgactggtatacatattaaagtttgagaaccactttcttctagtgaaccaacaggcaggcaggcaggcgtcaagcttggctgccagcttcttgctagatatgtcattttaggtctttcaagattgccctctgtgtgtgttatttaaggttggtatgcttttggttttctccttgggaaaagaaggatgagaatattgtttaaccacttctctacacaagtgtatgcaggagagcagttgctaagtgtttaaacaccacgctatagaaatgtagaaacaaccacagcattggtgttttttttttcttcattccagtctcatttccaggaacagcttttcttaaaggcctgaagactgaacattcatttcattaaaaatatatggcttatt

SEQ ID NO: 258969 - DNA, 360 bp, Homo sapiens
taaactcatagaattaatgagtaagcgcaacaaggtttcaagatgcaagatataaaaatcagttgttggccgggcgcggtggctcatgcctgtaatcccagcactttgggaggccgaggcgggcggatcacgaggtcaggagatcgagaccatcccggctaaaacggtgaatacaaaaatactaacggtctctactaaaaatacaaaaaattagctgggcgtagtggcgggcgcctgtagtcccagctacttgggaggctgaggcaggagaatggcgtgaacccgggaagcggagcttgcagtgagccgagatcccgccactgcactccagcctgggcgacagagcgagactccgtctca

SEQ ID NO: 258970 - DNA, 455 bp, Homo sapiens
tcctaatgaagcagcccatggtttctgagtgtcaaatttttaagaacgcacatgccgacaattgacaattgggctcaatatttcacagcgtctttttgttttctggtacactgtaagcagattactatgtaagtgattttcaaccctactagagaaagtgaagcacagagaaaccctttaaaagggtcagtttcacaaatgatgctagatctcagttcatagatccttatcttttactctctagcatatagtcagatgttctaaataaacttttttaaagaatagttttcgatttacagaaaagtcacaaaaatagtagacagttcccatatacccagtttctctattgtgtgagatgttgacatttgttttagtgtaagatgatacatttgttacaactaaggaatcaacaatggtacattactattaaataaactccacagtttatttggatt

SEQ ID NO: 258971 - DNA, 490 bp, Homo sapiens
gcatcctcccatgtccttggctgaccatttaattataaggtccaatcaaactaattacacattggggtccttgaagacagtaagtaattcaagtctgctttgctgctgaattccagaaaggtagattatttttattacagtcagtagatggggctgtggctcatgcagttgaaaaggcaaaccttgagaccaagggagtcaagagaaagagaagcgtcttcagatgacaaactctgtaagggctccatagtgggttagtggaagctccctgcttttcagagtcaggtatatgaattatttctagcaaaatttataaccatagaaagtaggttttctcatcagattatattactgagccacagctggtaatagttgagtcgtgtgaagattaaacaaggcaaaccagccagtgcactgttgggcatatagtaaatgctcaataagtggttattattttgatataatgattgttaattatttggtttagtga

SEQ ID NO: 258972 - DNA, 447 bp, Homo sapiens
gagttaggggaggggatcaactgcaaaagcacacaaagaaattttcaaaggtgttgaactgtcatatcttgattagaatggtggtggttatatgtttatatataattatcaaaattaatcagatcgtatacttaaagtggataaattttattgactgtaaataataccttgagttaaagtaggtgctttagagccagactaaacctggattcagtcccagctctgctgcttagtagctgtataactttgggccagtcatcttctctggaccttggtttgcccatctggaaatgtgtataatgatagctgccttggggattagaagacgtacaagtacttagcatatgcctggaacatgataaattatcagtaggttattattttactttatgatcgtcattctcctttataaaatatcccagtaatgctagtattttgcttatcagt

SEQ ID NO: 258973 - DNA, 369 bp, Homo sapiens
ttattggtagcattttaaagtctgttaagagattagttatttgtttgtttatactccaaaatatactcaatttcaaacatacctatcatttatttgcaagtatcatcatcaatcaagtaagcaataacaatgcacaaggcttagaagcagatttgtcatatttcaaaaagtggagctcaaagcaattcattttaagttaactttaaatttataaactcaaggcagtacaagtctggtttttttttagctacccaatatctgataaatatgaatacctaataatagacgataataacagtgataaaattaaaatgagagcaaaccactgaataatctattatttcttatttcttcctataaaggatgcac

SEQ ID NO: 258974 - DNA, 437 bp, Homo sapiens
tcccagaacctgtgtggagagcactttatcactggtatggagcaaacctggccttacctagaccagttatcaagaacagcaagacagacatcccagagctggaattatttccccgctatcttctcttcctgagacagcagcctgcctacattcttttctatgagcagcaggggatagactatgcacaatttctgccaaagactgatggcaaaaagatggcagacacaagcagtatggatgaagactttgagtctgattacaaaaagtactgtgtgttacagtaaagctaccactctggctgctagacagcttggcggtgagggagatgactccttgtagctgacatttggcaaaagcgtcactgaaaggcaagctaaatgtagttattttatcctgtggccctgaagcacaaaataaaaattctaattaaaatagtt

SEQ ID NO: 258975 - DNA, 372 bp, Homo sapiens
cggcacgagggtccctctggtctttggaaatctataaatggagggtatgatttaaattggcgctctgtacctttgaagattccatacataaacaaaatcaggcatacccagtagtgccatttgtcagaattagaaacctattaaacttagctaaaattgtagtggtgggagaagaattatttaaaaataactcacaaagaggtgaagcaagatagtgaaagagaaagctccactgatagtctcttctgcaaggacaccaagttaacaactatctacacaggaaaaaaaaaaacaaaacaacataggaataaaaaattaggtgagcactctcagtacttggttttaatttcatatttctgaaagaggcactga

SEQ ID NO: 258976 - DNA, 442 bp, Homo sapiens
gcaggcatagcctacaccctcaactgctcccttcagctgcttcaagatgaggaattagaaagacgcagggacgggatgggtggacggggagtagagatttggcatggccatggcgtcagaaacttggcttgggagtgaatttgtaaatggggaaagcatcttcttagcaaccatgcgtccaatcttctgcatcaaggagagagactgatgtgctcagggagactgcagaggagtgcagcaggtaaatgcaggggctctacagcccaaggttcttggtccaaatccccattctgctgctgcctatctccatgaacctgggacaagcagctccatcgttccgagactcagtttcctcaactgtaatgaaaggataagaatccctgcagggaaagggtgctgtgagaataaaatgaaactgtgcaagaaagtacagaagacatta

SEQ ID NO: 258977 - DNA, 330 bp, Homo sapiens
acaaaaattgttggccacatttttaagttcgcaggcgagggggaacgtctcatactctagccctcttgagcctagaccctctgtgagatgtgtcaccatttcttggacaccacgtgagacattccccctcagattagagatgctcagcctgcatcaacttatctaaagcctacatctggctactctggggcaagtcctgtttacagtgcccattcctggagcttgcctctgtttgtcttttgttcgattacatgatatattacttttcccaacaggccagtgctagcatattggaagagtgatttaataaagctggcaaccttgacgcta

SEQ ID NO: 258978 - DNA, 681 bp, Homo sapiens
gaagtgagtgcttttggtgaggaaggtgaaggtgattatctggatgactggacagtgctctgtaatggaccctactgggtgagagatggtgaggtgcggttcaaacactcttccactgaggtactgctgtctgtcacaggagaacaatatggtcgacctatcagtgggcaaaaagaggtgcatggcatggcccagccaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccatgtcaccattgagatgaagatatacaacagaaaatagtggctgtgtttggaagcttcagccctgcacatttgaactagtcactctcccagacttgcgtgggtcagttctttctgagtagaggacttgctggtaaaggggcagatgctttttattagtactgataaaacaaactgagggaaacatccctcttagctgggaaacttttactcttcaggagcttggcatcatggactgttaatgtatgtgattttccccctattttctctctccaaaatgataaaaacaataatttt

SEQ ID NO: 258979 - DNA, 322 bp, Homo sapiens
cggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtc

SEQ ID NO: 258980 - DNA, 480 bp, Homo sapiens
gccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaa

SEQ ID NO: 258981 - DNA, 445 bp, Homo sapiens
gagtgctccccgctggactctgccagtttgggggccgagtgctccccgctggacgccgtgcgtttgggggcggagtgctcccggctggacgccgtgagtttgggggctgagtgctccctgctggactccctgcgtttgggggccgggtcgtttggtgtttgctgtgccggccgcccttttctctccccagccccgggggcggcctttgcgtcctcgaagccccctcaggccctgtgtggggtgtccgagatgcaggtgcagaggctgtagcaccatgcgggtctttcacgtggcccagaagctgaaatgaagtgaaggcttcacagagcttaacccctgtcccctcacctgccctgaagggacaccgggtcatgttctggactgagtcataaagtgcaggccaggaggcggcaggagaggcgcaaggaggagccccaggaagggc

SEQ ID NO: 258982 - DNA, 715 bp, Homo sapiens
tatatcccttaaagatggtcgggcgcgccctaggcagatggccaggccaggcttaaaaaatagattgccaggtggccctgcccaccacgcgccccacagagtgtacatgtgtccacacctataagagaagcacgggccggaaagaggccatgtgttacacacggcttgacaccgccggtgccaagaaagagccaagcagccactccctggggctggctgcagatgaggcccttgtggtttccccactcactgactacggggaggagggtgtgcaaggactttgtctgggaagaatctttgcatctgtagctcaacaggcttctctctccaggcccctgggtttcaaaagactgtgacttccaccttggtttgctcggtctgatgaaggaactttgagctgtgagctgcactgtgaactttgctgtgagctgccctgtgatgggagaggaggcctccgcctcacagccctggaggacctcaatgctgccaacgtgtgaccagatgcagatccttctccagtcaagcctggacatgacatgacagcagccctggggaccttgatgctgtggcctgtgcaagaccctgagccagccgcacccagatccctcacccacagaaactgccagattttaagtcttctgcttgtaagccactctttttgccatagtttgtgtgcagcaatagataactgctctagagttgttaaatgagtaag

SEQ ID NO: 258983 - DNA, 260 bp, Homo sapiens
aagtgaaattctttgtattgaacaataacaaatgcactaggcatctaaatagcaaaggaaagttcttagttttaagtacaaatattcaaaaaattattaatagacttcaattaaagaaaataaacaatcgaattaatttcaaataaagcacaaaggagaacataacaaatataaaagcaagaggaatacaatagaaaataacacatcactagagatggcttaaaaattagtttttccaaaaataaaaataaaaatgttga

SEQ ID NO: 258984 - DNA, 406 bp, Homo sapiens
gtatgagacatccctccctccatgttgcggaatagtctgtagccaaccatgtacctgaggatagtggggggaaatgtcagtggttcgttcataaagcaattgaatgagagggagaactaggacagttaagagagatgtcagtggcctagagtaaagccctcctcattctggtatttagagaaatatgaggacaagctccccgcctatttaccctaatgaaaaactttaaattaacaaattctgcaacattaccagagttttttatctttaaatgtgattggacatcaatagattaccaaaagaaaacattcaacacacaagagaaagacctagaaaaagagacaaaacaatgtttccagagtaaagagaaagagttcagaaaaaataaattcaaatgaaaatataa

SEQ ID NO: 258985 - DNA, 722 bp, Homo sapiens
gtcatttgtttatcacgggtaaaacagatttcgtattgactggtttgactcaggactatggtattctaattaagattgctaaaaagaactatagaattaaaccctaagttaaaataagcagatatgcaatggcacacacacaactatattctgctccaattcacaagtaattccatactacaatgattcaagttcattctcaagaagactatacagaagagcaaaaatagagtttagatgataaaaatcacattttattgctgtaattttctttcttactttagaatcattcatttatcagccattagcctatatatcaaatatcactactttttctaaaggcagttgagtttcatcaaatgcatttctccaaaaacaataactaaaacccatagtaacagacatttagcataacattctttttttttttttttttaactatactttaagttctagggtacatgttgtcaggcctctgagcccaagctaagccatcatatcccgtgacctgcaggtatacatccagatggcctgaagtaactgaagaatcacaaaagaagtgaaaatggcctattcctgccttaactgatgacattaccttgtgaaattccttctcctggctcatcctggctcaaaagctcccccactgagcaccttgtgacccccacccctaccagctagagaacaaccccctttgactgaattttcctttacctacccaa

SEQ ID NO: 258986 - DNA, 451 bp, Homo sapiens
tctgtgggccaagcgatccctgtgtggccgagtctggaagtctcatggctgggttctggacctgcaggatgattctggggagaagggtcgtcccagcttaaggtcatggagtcaagaccttttgttttcctttggcctttctagtccatttgagaaagtcaccttttcaaacccctgccagctctgcctagtactggaaaggccccagcaagagtgtttgacgttaggggaagtttggggaaaaatctctaagcatataaacattgagaattgaaagtctgatcagtcatccaaaagttatggacttttgctgtggttcaggccccagctggggctagggaccctgaaatgagctgccctctgtccagcctgggagcttgtgtgggaagatgctacaaatcaggaccctgtcagggatggggagggcctcttgaaggtgctttgggcacgc

SEQ ID NO: 258987 - DNA, 213 bp, Homo sapiens
agccgtaagcagtcctcccgcctgaatctgccaaagagctgggattacagatgtgagctaccacacctggccccatataattcttgagttagtaacattcaacacaaatgaccaatccctccgttaaacctttcttctgacttccgtgacatcacagaatttttcctttacttttagatgtaagaattccttaatcattggcctccttcgctt

SEQ ID NO: 258988 - DNA, 379 bp, Homo sapiens
gcaggacaggggaacactcgtggctggacaatgaagagctgtcctgcatcctgcacatcttctgaacgtccccagatgtcctccccttgcaaccaagtgtggaccactggccagcaacatctgcatcacctgggaacgtgttagatgtgcagaatttcagccccagcctggaccacaggaatcagggtctgcacattaacagcatccccaagcaattcgtctgcacatcaaaaattgagaatagagacagcgtttcaccatgttggccaggctggtctggaactcctgacctcaagtgatccacctgcctcagcctcccaaagtgctgggattacaggcatcatcatttaaataataaaacatattatctgtttataaa

SEQ ID NO: 258989 - DNA, 436 bp, Homo sapiens
gccattgacaccaattgccaggaaagactgctcactaacctgagggaacctgtagggcttagcttctctggtagcttcctgaatgggctgagtgacgcgacctggaaatggaaggatgctttgttcccatgcagaaaaccctgagcaatggaattctgaagatggttatatgtgcttatccactggtggagccatgagtagtgctgcgtcctcaatagttagaatacatggatggggcttggagccagcataaagacaaaatcagaatagctattaatcccatcctgtagacataacccccataattattttgatgtaattacttccaattttttcctgtgcatatataaaatatatagctacaaaagtgagattctactataggaagattttcatattgctttgtaaaagcattacattatattgaatatattga

SEQ ID NO: 258990 - DNA, 740 bp, Homo sapiens
ttgctttctcacctcacaatattgtaaagttgaacaatcttaaattgaactatcgtcctaagttagggaccatctgtaatcacagggtagggagaagatcaggatatgttaatacagtggttgtcactcattgctgctctctgacaaagacttcagccctttgtgaatattatcaatgtaagattgttaacttttttttaaggtgagttgttcctttttccaagatttgtcttttatgacatactgtctttaatgaaattgtgatattaaaatttttaatcttctacttatccaaataaaataggcaatcctgtgtcagtccttaaaacatcttttgaatttttttagcttgatgtaatccaggtttgagaactgctggtctaatgatgtaatgtcatggaaatcaggggatttaagatgggttttgctaaggaacatgtaaacagtgtaagccattgaagttggggattcacaggttattgactttttcttttttttgacaatttcactctttcacacaggctggagtgcaatggcacaatctcggctcactgcagcctcccgctcccgtgttcaagagattctcgtgatttagcctcttgagtagctggaattacaagcctgggccaccgtgcctggctttcattgacttttgagagtatattgattagggttctttgttctggcctggagtgcagtggcgtgatcttggctcagtgcaacctctgtctcccggattc

SEQ ID NO: 258991 - DNA, 307 bp, Homo sapiens
cagcttggggaaatgaccttgagaggaagttggaagagggaaagagggagctggctctgcccaccagtatgtaaaaattaaataacaaaaagaaaaccagcagcccacaaccgccctccctgccacccaagcaattctcctatccctctatgcattcacatgacacatactccacccctcccatgggccgggcattgagttaggacccagggtataaagaatcaaaaatgggttataactctttaggagcttaaattctatgaaggtagacaaaatatctaccatagaaataggcattgaggaacca

SEQ ID NO: 258992 - DNA, 213 bp, Homo sapiens
gtgtttcctcactgaatatgttcattatgtgtgtacatactgtaaggatagctcacagtggcgggacatgtgttttataggatttttttctaagtggcccaagagtatacaggcatacctaattttgttgtgctttgctttattgtttttgctttattgtgcttcacagataatgcatgttttagacattgaaggtctgtggcacacttatat

SEQ ID NO: 258993 - DNA, 738 bp, Homo sapiens
cttgttttacagggtgaaaactgaggtttagagagggtaaataacttgcccaaaatctggaaaagtttgccaacccctggtcttactcctcattaaggtttcccttcctctccaccattcccaaatctgagtattccagaagagctactgtttttttaatgatatggtaaattaatttctaaagggattaaaatgaatacctacctgttgtaatgaaaataaatgtataacataaagcaatctgcaaaataactgttttgcaggcctaagacttatgcagaggtggcgcccgcccgtaatcccagcacttcgggaggccgagacgggcggatcgcttgagaccagccaggacaacatggcgaaaccacatctctacaacaaatacaaaaattagctgggcgcggtggcacacgactgtggttccagttactcggcaggcggaggtggaaggatcccttgagcctctggaggtggaggttgcagtgagctgtgattgcgccactgcactccagcctgggcgacagagtgagaccctgtcagaaaacaaaacaaaacaaaagaattctgtaagaacttctaacaggtacattcctgtaagcattacccaccactggactaggcactgggtagcctgtaaaatacagtaagagctgtctctgcacccagaaaatttaccatcattttgtgctggaaagacatgccctagaaaacaataaacagcacgactgtacatgattc

SEQ ID NO: 258994 - DNA, 1547 bp, Homo sapiens
cttctttaaatttctttctaggatgttcacttcttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttca

SEQ ID NO: 258995 - DNA, 1402 bp, Homo sapiens
cttctttaaatttctttctaggatgttcacttcttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagaggtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttca

SEQ ID NO: 258996 - DNA, 109 bp, Homo sapiens
gcgttcctcttgttgttggtaacacaggaggtctcacattgggatctttgaattgtgtttgtgatgtgagatgattatacaaaagttagagtgaaattccctttttttt

SEQ ID NO: 258997 - DNA, 549 bp, Homo sapiens
aaatcagaagacaactaaatagaaaaatgggcaaaatatataaacaggcagtgattttacagaagaatcatcaatatgaaaaggagctcaatctcaataatccttaattaagaataattaacataaccttaataataattaagctcaaccctcactaataaaagtggaaaggcaaatttacacacccatcaaacaggcaaaattttaaacatctgatcacatcaaatgtttcgcaaatgtcaagaggcagacttacatactgcttgtggagtgtaaactggtgcaaccactttggaaaataatttggcattaacttgtaaaacactagagaaactcttgcacatttgcacgaagagctatgcacaagaaatttcatagcagtacatattgcaatagcaaaggcctggaaagaactcaaacatttacggacatttaaatactttcactaattgcattttactcaatcaatggaaaactgtcagtgaaaatataccacaactacataattcagtgaagacaaatctcagaaacatgttgaacaacaaatgc

SEQ ID NO: 258998 - DNA, 626 bp, Homo sapiens
cagagcaagactctgtctcaaaaaaaaaagaaaaaaatatgctaagtgaaataagccagtcccaaaggacaaacactgcatgattccacctagatgaggtactcagaatagtcaaatccaaagacgggaagtagaatgggagttgcgggggctggagagagggaggaatggagagataccatttaataggaataaagtttaagttttgcaagattgagaagttctggacgtagtttacacaacagtgtgaacagtactgagctgtacacttaaaaatggttaacatggtaaattctgtgttatatgtcttttaccacaatttttaaaaatcaaaaatcctgaaaggtacttcctgtggatgtgcaatgggctttccgcagcattgcttatggcatgagcacagggaaagccttctgcagtatacatcaaggtccttgacaagttcacactctgaatgccgtcattctgcttcggggactcctcccaagggagtaagcccaactcaaggaaaggctttactaaccagcgttgttcatgttagcaaaaagttggaagccaagactcttgaaaagctttgtgtggttaaataaaccctgagcacccactggccagaaacacatgcagct

SEQ ID NO: 258999 - DNA, 444 bp, Homo sapiens
cacatatgacattttacatctaatttggagagttttaagatgcccccatatccacgcatgtgccctttagtgcagaattcccgccccaaatattcatcattgtaaccctttattctaggttccatccactgactggtatagatgtcattcatgtataactaccagatttccccctgaatcacatgcagatgaagaagagtgtgtgagcacaggattcatgaatgcctagtgcaggaagttataggtattgaaagggaaaagcaatacatcactcatttgatctgctctctttcagatcataggatgtagtggtagatggtcacatattaaactttaaagaggtgttggctttcttcccccttgcatttaaaaggtgatgtgctgcaatgtgagacaaatcatgattcactacaacagtgttgcagtcagttatataaattgcca

SEQ ID NO: 259000 - DNA, 389 bp, Homo sapiens
tacacccaaccttgatttgaacacctcctggaaaagagaagaaactgcctatgctaccagtcttaggaatgaatacaggaaaagacttttctctctgaatattaaggccgggtgcagtggttcacacctgtaaccccagcactttgggaggctgaggtaggcagattacctgagttcaggtgttcgagaccagcctggccaccatggtgaaaccccatctctactgaaaacacaaaaattagtcaggcatggtggcaggcacctgtaatgccagctacttgtgggagctaaggcaggaaaatcgcttgaacccgggaggtggaggctgcagtgagcagagatcgtaccactgcgctctagcctggacgacagagcgagactccacttca

SEQ ID NO: 259001 - DNA, 633 bp, Homo sapiens
aaaacttttcattaaaatgaaaatcctgaagaaatgtagttttttttcactgtcaaagaacaaatacaattatgaatgagtgagtcattgttctcctgagtcatttcatgaacttataacagtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttt

SEQ ID NO: 259002 - DNA, 7100 bp, Homo sapiens
gacatactgagaataaatccaaagacattagtttctttgcacgaaatgaggttacatatccagtgacatttatttgagctatttaaacaacttaaacatctttttcttttcttaataagggacgtttcaagttgtggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccgtagccgtcgctgctcccggcatgccccgccccccacggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagataagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaagaggaagaaaccataaaatggacaactactgtcagtaaaactggtccttctaataatgatgaaaagagtgagatgagttttccaggaagaacagaaagtcgatcatctggtttaaagcttgcagcatgttcattctctgcagatgtgtcacctatggagcgaagcagtaatcaagagggcagtttggcagaggagataaacattcaaatgacagatcaagtggctgaaacttgcagttctgctagttgggagaatgctactgtggacacagatatcatccagggaactcaagaccaagcaaagcatcgtttttataggccccctacacctggactaagaagagtgagacaaaagaaatctgtgattggcagtgtgaccttagtatctgaaactgaggttcaagagaaaatgattggacagttttcatatagtgaagaaagggaaagtggggaaaacaagtctgagtatcacatgtttacacattcttgcagtaaaatgtcatcagtatctaacaaaccagtacttgttcagatcaataacaatgatcaaatggaggagtcatcattagaaagaaaaaaggaaaacagtctgcttaagtcaagtgcaataagtgctggtgttatagaaattacaagtcagaagatgttagagatgtcacataataatggtttgccatcaactatatcaaataactcaattgtggaggaagatgtagttgattgtgtggtattggacaacaaaactggtatcaagaacttcaaaacttatggtaacaccaatgataggttcagtcctatttcagcagatgcaacccatttttcaagtaataactctggaactgacaaaaatatttctgaggctccagcttcagaagcatcctctactgtcactgcaagaattgacagactaattaatgaatttgctcagtgtggtttaacaaaacttccaaaaaatgaaaagaagattttgtcatctgttgccagcaaaaagaagaaaaaatctcgacagcaagcaataaattccaggtatcaagatggacagcttgcaaccaaaggaattcttaataagaatgagagaataaacacaaaaggtagaattacaaaggaaatgatagtgcaagattcagatagtccccttaaaggagggatactttgtgaggaagacctccagaaaagtgatactgtaattgaatcaaatactttttgttccaaaagtaatctcaattccacgatttccaagaatttccatagaaataaattaaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacgtaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgacaggagataatctatgtaaagagggagataagtcttttattgccaatgacactggtgaagaagatctccatgagacacaggttggatctctgaatgatgcttatttggttcccctgcatgaacactgtactttgtcacagtcagctattaatgatcataatactaaaagtcatatagctgctgaaaaatcaggaccagagaaaaaacttgtttaccaggaaataaacctagctagaaaaaggcaaagtgtagaggctgccattcaagtagatcctatagaagaggaaactccaaaagacctcttaccagtcctgatgcttcaccaattgcaagcttcagttcctggtattcacaagactcagaatggagttgttcaaatgccaggttcacttgcaggtgttccctttcattctgcaatatgtaattcatccactaatctccttctagcttggctcttggtgctaaacctaaagggaagtatgaatagcttctgtcaagttgatgctcacaaggctaccaacaaatcttcagaaacacttgcattgttggagattctaaagcacatagctatcacagaggaagctgatgacttgaaagctgctgttgccaatttagtggagtcaactacaagccactttggactcagtgagaaagaacaagacatggttccaatagatctttctgcaaattgttccacggtcaacattcagagtgttcctaagtgcagtgaaaatgaaagaacacaaggaatctcctctttggatggaggttgctctgccagtgaggcatgtgcccctgaagtctgtgttttggaagtgacttgctctccatgtgagatgtgcactgtaaataaggcttattctccaaaagagacatgtaaccccagtgacactttttttcctagtgatggttatggtgtggatcagacttctatgaataaggcttgtttcctaggagaggtctgttcacttactgatactgtgttttctgataaggcttgtgctcaaaaggagaaccatacctatgagggagcttgcccaattgatgagacctacgttcctgtcaatgtctgcaataccattgactttttaaactccaaagaaaacacatatactgataacttggattcaactgaagagttagaaagaggtgatgacattcagaaagatctaaatattttgacagaccctgaatataaaaatggatttaatacattggtgtcacatcaaaatgtcagtaatttaagctcctgtggcctttgcctaagtgaaaaagaagcagaacttgataagaaacatagttctctagatgattttgaaaattgttcactaaggaagtttcaggatgaaaatgcatatacttcctttgatatggaagaaccacggacttctgaagaaccaggctcaataaccaacagcatgacatcaagtgaaagaaacatttcagaattggaatcttttgaagaattagaaaaccatgacactgatatctttaatacagtggtaaatggaggagagcaagccactgaagaattaatccaagaagaggtagaggctagtaaaactttagaattgatagacatctctagtaagaatattatggaagaaaaaagaatgaacggtataatttatgaaataatcagtaagaggctggcaacaccaccatctttagatttttgctatgattctaagcaaaatagtgaaaaggagaccaatgaaggagaaactaagatggtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctggatgttcgcaatgaaacctgtgccaaggaaagaatagcaaatcatcatacagaggagaagggtagtcatcagtcagaaagagtatgcacatctgtcactcattcctttatttctgctggtaacaaagtctaccctgtctctgatgatgctattaaaaaccaaccattgcctggcagtaatatgattcatggtacacttcaggaagctgactctttggataaactgtatgctctttgtggtcaacattgcccaatactaactgttattatccaacccatgaatgaggaagaccgaggatttgcatatcgcaaagaatctgatattgaaaatttcttgggtttttatttatggatgaaaatacacccatatttacttcagacagacaaaaatgtgttcagggaagagaacaataaagcaagtatgagacaaaatcttattgataatgccattggtgatatatttgatcagttttatttcagtaacacatttgacttgatgggtaaaagaagaaaacaaaaaagaattaacttcttggggttagaggaagaaggtaatttaaagaaatttcaaccagatttgaaggaaaggttttgtatgaatttcttgcacacatcattgttagttgtgggtaatgtggattcaaatacacaagacctcagcggtcagacaaatgaaatctttaaagcagtcgatgagaataacaacttattaaataacagattccagggctcaagaacaaatctcaaccaagtagtaagagaaaatatcaactgtcattacttctttgaaatgcttggtcaagcttgcctcttagatatttgccaagttgagacctccttaaatattagcaacagaaatattttagaactttgtatgtttgagggtgaaaatcttttcatttgggaagaggaagacatattaaatttaactgatcttgaaagcagtagagaacaagaagatttataatttcaatatcagcacactcattctttgtcaattcattttttcccatgagatgaagcacatgtgacgaatacggactagataacctctaagaattttccacttcttcaaaatgaacttactctagaaagcttacccttggataaccagtttgactttcataatgtctctgttttttgtttttccaacaattacagactcaggttctcttattttggaagtttctatctggttttgttctgaacttacattttttttttttttggtatctatgattttttttgctcagggcatcaaaatgtgctaaggacaagaattatatcctttttaaaaaatgttgttagcttggtgtaaaatgtatattgactgtattggtgaataaattgaatagacataacctcaaagtacttcacttattctttttaactactgatttgataaaaagtatgattataagatatccacgacaatctcatagtttctt

SEQ ID NO: 259003 - DNA, 7011 bp, Homo sapiens
gacatactgagaataaatccaaagacattagtttctttgcacgaaatgaggttacatatccagtgacatttatttgagctatttaaacaacttaaacatctttttcttttcttaataagggacgtttcaagttgtggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccgtagccgtcgctgctcccggcatgccccgccccccacggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagataagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaagaggaagaaaccataaaatggacaactactgtcagtaaaactggtccttctaataatgatgaaaagagtgagatgagttttccaggaagaacagaaagtcgatcatctggtttaaagcttgcagcatgttcattctctgcagatgtgtcacctatggagcgaagcagtaatcaagagggcagtttggcagaggagataaacattcaaatgacagatcaagtggctgaaacttgcagttctgctagttgggagaatgctactgtggacacagatatcatccagggaactcaagaccaagcaaagcatcgtttttataggccccctacacctggactaagaagagtgagacaaaagaaatctgtgattggcagtgtgaccttagtatctgaaactgaggttcaagagaaaatgattggacagttttcatatagtgaagaaagggaaagtggggaaaacaagtctgagtatcacatgtttacacattcttgcagtaaaatgtcatcagtatctaacaaaccagtacttgttcagatcaataacaatgatcaaatggaggagtcatcattagaaagaaaaaaggaaaacagtctgcttaagtcaagtgcaataagtgctggtgttatagaaattacaagtcagaagatgttagagatgtcacataataatggtttgccatcaactatatcaaataactcaattgtggaggaagatgtagttgattgtgtggtattggacaacaaaactggtatcaagaacttcaaaacttatggtaacaccaatgataggttcagtcctatttcagcagatgcaacccatttttcaagtaataactctggaactgacaaaaatatttctgaggctccagcttcagaagcatcctctactgtcactgcaagaattgacagactaattaatgaatttgctcagtgtggtttaacaaaacttccaaaaaatgaaaagaagattttgtcatctgttgccagcaaaaagaagaaaaaatctcgacagcaagcaataaattccaggtatcaagatggacagcttgcaaccaaaggaattcttaataagaatgagagaataaacacaaaaggtagaattacaaaggaaatgatagtgcaagattcagatagtccccttaaaggagggatactttgtgaggaagacctccagaaaagtgatactgtaattgaatcaaatactttttgttccaaaagtaatctcaattccacgatttccaagaatttccatagaaataaattaaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacgtaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgacaggagataatctatgtaaagagggagataagtcttttattgccaatgacactggtgaagaagatctccatgagacacaggttggatctctgaatgatgcttatttggttcccctgcatgaacactgtactttgtcacagtcagctattaatgatcataatactaaaagtcatatagctgctgaaaaatcaggaccagagaaaaaacttgtttaccaggaaataaacctagctagaaaaaggcaaagtgtagaggctgccattcaagtagatcctatagaagaggaaactccaaaagacctcttaccagtcctgatgcttcaccaattgcaagcttcagttcctggtattcacaagactcagaatggagttgttcaaatgccaggttcacttgcaggtgttccctttcattctgcaatatgtaattcatccactaatctccttctagcttggctcttggtgctaaacctaaagggaagtatgaatagcttctgtcaagttgatgctcacaaggctaccaacaaatcttcagaaacacttgcattgttggagattctaaagcacatagctatcacagaggaagctgatgacttgaaagctgctgttgccaatttagtggagtcaactacaagccactttggactcagtgagaaagaacaagacatggttccaatagatctttctgcaaattgttccacggtcaacattcagagtgttcctaagtgcagtgaaaatgaaagaacacaaggaatctcctctttggatggaggttgctctgccagtgaggcatgtgcccctgaagtctgtgttttggaagtgacttgctctccatgtgagatgtgcactgtaaataaggcttattctccaaaagagacatgtaaccccagtgacactttttttcctagtgatggttatggtgtggatcagacttctatgaataaggcttgtttcctaggagaggtctgttcacttactgatactgtgttttctgataaggcttgtgctcaaaaggagaaccatacctatgagggagcttgcccaattgatgagacctacgttcctgtcaatgtctgcaataccattgactttttaaactccaaagaaaacacatatactgataacttggattcaactgaagagttagaaagaggtgatgacattcagaaagatctaaatattttgacagaccctgaatataaaaatggatttaatacattggtgtcacatcaaaatgtcagtaatttaagctcctgtggcctttgcctaagtgaaaaagaagcagaacttgataagaaacatagttctctagatgattttgaaaattgttcactaaggaagtttcaggatgaaaatgcatatacttcctttgatatggaagaaccacggacttctgaagaaccaggctcaataaccaacagcatgacatcaagtgaaagaaacatttcagaattggaatcttttgaagaattagaaaaccatgacactgatatctttaatacagtggtaaatggaggagagcaagccactgaagaattaatccaagaagaggtagaggctagtaaaactttagaattgatagacatctctagtaagaatattatggaagaaaaaagaatgaacggtataatttatgaaataatcagtaagaggctggcaacaccaccatctttagatttttgctatgattctaagcaaaatagtgaaaaggagaccaatgaaggagaaactaagatggtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctggatgttcgcaatgaaacctgtgccaaggaaagaatagcaaatcatcatacagaggagaagggtagtcatcagtcagaaagagtatgcacatctgtcactcattcctttatttctgctggtaacaaagtctaccctgtctctgatgatgctattaaaaaccaaccattgcctggcagtaatatgattcatggtacacttcaggaagctgactctttggataaactgtatgctctttgtggtcaacattgcccaatactaactgttattatccaacccatgaatgaggaagaccgaggatttgcatatcgcaaagaatctgatattgaaaatttcttgggtttttatttatggatgaaaatacacccatatttacttcagacagacaaaaatgtgttcagggaagagaacaataaagcaagtatgagacaaaatcttattgataatgccattggtgatatatttgatcagttttatttcagtaacacatttgacttgatgggtaaaagaagaaaacaaaaaagaattaacttcttggggttagaggaagaaggtaatttaaagaaatttcaaccagatttgaaggaaaggttttgtatgaatttcttgcacacatcattgttagttgtgggtaatgtggattcaaatacacaagacctcagcggtcagacaaatgaaatctttaaagcagtcgatgagaataacaacttattaaataacagattccagggctcaagaacaaatctcaaccaagtagtaagagaaaatatcaactgtcattacttctttgaaatgcttggtcaagcttgcctcttagatatttgccaagttgagacctccttaaatattagcaacagaaatattttagaactttgtatgtttgagggtgaaaatcttttcatttgggaagaggaagacatattaaatttaactgatcttgaaagcagtagagaacaagaagatttataatttcaatatcagcacactcattctttgtcaattcattttttcccatgagatgaagcacatgtgacgaatacggactagataacctctaagaattttccacttcttcaaaatgaacttactctagaaagcttacccttggataaccagtttgactttcataatgtctctgttttttgtttttccaacaattacagactcaggttctcttattttggaagtttctatctggttttgttctgaacttacattttttttttttttggtatctatgattttttttgctcagggcatcaaaatgtgctaaggacaagaattatatcctttttaaaaaatgttgttagcttggtgtaaaatgtatattgactgtattggtgaataaattgaatagacat

SEQ ID NO: 259004 - DNA, 1204 bp, Homo sapiens
tcaggggcttctggaatctctacccactccagccaactctgaggccatgtggtcctggaacaaggcccctctgaggcagatggggcaggcggcccaggcacatagcatggttggctctgcggcccagggcgcacaaaggccttattgagtcaccaccagcccccggcagaggctgaggtggcagtggcgccgagcgcctgccacctaatgactgtcctggtccagccagatgttccacagacctccggagcatggtggcccagcccaggcggtaggcctggcccgcagagcctgcgagtctagactccagatgtgaaccgccaccatcagagtcccatggaaaaatggcaccaggccgggcaaggattgggcctgcatgctggggagggggtgtgggtggttgggcagggccccgagtgggctagatgccagcctcacctggtttggggtggattattaggaaactgctctagaacccaagttctaccctgctttattagattctgtttctgtgcctcagtctcccatgactgcgacaagagagagggttccaaggggaaaaccagccctgctgagaccccagtgtgcactgactgtatttcacgtgactagcattatgctagtgcaactgacccttgaacaacacagggattaggggcaccaacccatcatggtcgaaaatctgtataacttttcagtcccgcaaaacaactaatagtctgctgttgaccagaagccttacctgataacataaacagtcaaaacatcttgtatgttatacgtactacactgtctaccatagagtaagctagagaaaatgtaattaagaaaatcctaagagccaggcatggtggctcatgcctgtaatcccagcattttgggaggccaagatgggcagatcaggaggtcaggagatcgagaccatcctggctaacatggtgaaacccccgtttctactaaaaatacaaaaaattagccgggcatgatggcaggcgcctgtagtctcagctactcgggaggctgaggcaggagaatggcctgaacccgggaggcagagcttgcagtaagccgagagaggcaggcggatcacaaagtcaggagttcgagaccagcctggccaatatggtgaaaccccgactctactaaaaatacaaaaattagcctggcatggtggcaggcgactgtagtcccagctactcaggag

SEQ ID NO: 259005 - DNA, 191 bp, Homo sapiens
attttatattgaggaaactgagatggagggatgccatttaacttctttaacttcacgttactagtaaatggtgaagtcagaatttgactccaaagttagggctcttaattactattattttcctccaggatgagaagcacacctatgtgtcttttaatcctcgtcctgcagtcctggctcttaaaggagta

SEQ ID NO: 259006 - DNA, 590 bp, Homo sapiens
tttattagcatttgtggaatttattcccaaactctcctaatcttccgtacacaaccatttgatttgcataacccaaccccctctcataaaaactggctgctagtttaattaaaaaatgtaaatttgctgtcatctcggggcctggtgaattaggacgacatcggcattttttattgctaaagacgtccagattgatccagcccttggctgaactatggtgggggaaagggggtccacatggcccctgagggtcctgaggtccttctgtcccctcctgagaaggcttggctctcccaccactgacttcctcatggctgaaggccttcaggacctagatgtgtccggggccgcggggatgttaacctacgatcagggaggcatggtgggtccatgatgccagcagcccttcgaggcctgcgcccctggccttggactatgtcagagaggccctcggctgaagctgcccacgctgccccagaggaagggaccctcacttcaccagccacgagccccggccagagacgaggcccatggccccagctgtatgccgtgtgcactatgaagttgagggagctgttcccagctcctga

SEQ ID NO: 259007 - DNA, 579 bp, Homo sapiens
cacccatattactgtaagttcacctctttcctggagaaatcttcttggggactttacagtagctaatttttcagatctccaaaaataaactgatatatgttgtacatttgtggccagaaaagttgagccactggtattttatcctggaaacatcattatgatgtactaattgtgactataaatcctaaattgaaaaaattacctaataatttctgaaaaacctcactttcagacacttgacaaatttagcctgattctaaatcatggtactaaaatgtgagaattcctgactggaagctagtcactctgttaacatataaattctgtgtttctaataaggaggtggaccttacacagaggcatctgtgtgtgcgtctgtatctattcacattcacaggatctaccccacaacatcagaatcttgtcggtgacatccctgtgtggaggaacaatgcgggcacctttgttggccatgctgtgaacaagcacagccatctactaaggacacagggctgtgaaggacaaagagacacccctccaggaagccttcctgctgacaactgggtcacgacacacaaa

SEQ ID NO: 259008 - DNA, 381 bp, Homo sapiens
aatgtcttcattagttatcttcaaactcagagggtcaataatcacagcaagaggagcaccatgccttctggaaggatgtcaaataagcatgctgaatggcctacagttttgtaattggcaagacccccctaacacagattgagtgttacagatctgcaaagttcagtgctaaaatatgattgattagtgtgcaaatatttactgagcatctattttatgacaggctctataacagatgctagggatatgacatttgtatgagtccattctcacactgctataaagaactgtccaagactgggtaatttataaagaaaagaggtttaattgactcacagttccacatggcagcagaggcctcaggaaacttatcatggcaga

SEQ ID NO: 259009 - DNA, 440 bp, Homo sapiens
acccaactcaaaatctccatgggaaaatacctgtcgatacccacagtattgttgaaaataatcagatgcagtatcacagctgtgtcagactctagtaccagttgggcaatcaaggcacagctaaaaattgaaaacaaagatctggacaacaaaacagccaaaggtgggggtcaagaagctctgacgtgtacctagctgtagaatgctatgcacatgtgccaggtgtagtgtgcatatccaggaaaaactgcagagagccccagtcttcacctctggttgaccatgagctctgtgtaagcaggaagtgaaggctaaggcagatttaagctctgaaagcattccacaacatacacacaaatcgtgcaaagcattaaggaaatcttgttactgctaagtgttgctgacccaggaacaactcctactcagctggacttaaaaat

SEQ ID NO: 259010 - DNA, 534 bp, Homo sapiens
acactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcagtattcaatatattaaagttttcatttaaaacgtaact

SEQ ID NO: 259011 - DNA, 645 bp, Homo sapiens
ttggggatgatagaaatgcttagatccagctctgggttacaagagaaagtcagactttcccagaaattctgggaagtatggagagattcatgggatgagctcagcacaggataccagagtgtcttggcatcagcagcatgagagcaaagtatgagccttgatggcaggaatcatggcagacaagcatttagaaagtttattctgctctttggccaagtattggttaaaaggaaagcagttgaaactgtaaccaaagaaggcatatgcttccagaaatatctcaagaaaaaatattgcaagtaacagtagtagctgttggattgggctctaaagtgaaggttgaagagattcaaccagttagcatgaaagttggtgataaagttcttctccaactttggtgccagaatatgtagtgaaagttggagataaagttcttctcccagaatatgcaggcaccaaagtggtgctaggtgacaggaattatttcttatttagagatggtgacattcttgggaagtacgtagactaaaatagatcactattgaaatagcatcaacatgagctcgtgcattccactgaagttctgaaatctttcatcatgtaaacaattttcgtgcctcccttttataataaatgaattatatc

SEQ ID NO: 259012 - DNA, 584 bp, Homo sapiens
gggcagatcacctcaggtcagtagttcaagaccagcctggccaacatggtgaagccctgtctctacaaaaagagcctgaggcaggagaattgtttgaacctgggaggcagaggttacagtgaactgagattgtgcctaattattctcatatatttcttttttcttcacccctgaagagttagtgatggtgacaactgcagctgtgggtttgacggctatagcaatggtagtgcaggcagtcattgtttgtttgtttttttttgtttatgaaatgattgaaggaacttacaatattgttcctgaaggggtgagaacttggggtagtgacagttgccttcgactctatgatgtgctttatatgtagagaaactgctggacttttctgttttgctctaaacttttgaataataggcagtgggcattgaaaggcaggttgatgtagggtgtggtggttcacacctataatcccagcactttgggaggctgaggcgggcggatcacaaggtcaggagttcgagaccagcctggccaatatggtcaaaccccgtctctactaaaattacaagtaattagccaggcgtggt

SEQ ID NO: 259013 - DNA, 123 bp, Homo sapiens
gatctccactggctcccttaccaggcgacgtctagctctatgggcgtcttcacccaacaggtagtactgcagtggatttgaccagaggtcctctttaataatctgagcaatcctgtcggactc

SEQ ID NO: 259014 - DNA, 1662 bp, Homo sapiens
atgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggaccgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaagtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctag

SEQ ID NO: 259015 - DNA, 1271 bp, Homo sapiens
  misc_feature (16)..(16): n is a, c, g, or t
gcagttggtacccccnggagttaatggatatccgtcagaccaggccgcttcgagccacggatatttggcaggatgactccgaatgctccgagaaccacagcttcaagcaaaacgtggaccgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaagtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctag

SEQ ID NO: 259016 - DNA, 317 bp, Homo sapiens
taatcttgttaggactgcccatgacttctcatcaactggaagcagcagtacagtagaaggagcggtgtacatgggattgtggttttggttctaccaccatctatctgacttctctgcacttcatttgtctcattgttaaaaacctgtcatcattttgacatgctacgttctcttgcaacgtagctacatgtgtataattgcttaatgtggtctcttgctgatgtgtttctttttaaacttcttgttgacattatttagctctcttgtatcttccaaattttttcagaaaagattggtctaaggttaaaacataattt

SEQ ID NO: 259017 - DNA, 196 bp, Homo sapiens
gatctcccacctcggcctcccaaagtgctaggattacaggggtgagccactgcgcctagcctgcttgctttctttaggtcacaaactaagatagtaatctctaatatttagcacatattgataaatatttggtgaatgaatgagtagcacagagagttgtagaccaagtagctgtaggttagcaagttgccagatc

SEQ ID NO: 259018 - DNA, 437 bp, Homo sapiens
gacttcaaatgacttcaggctgattccagaaagctaatacaccctcaaaggacaatgcaccttcatttagctcactcaggagagaggccacagtcttgaggggaggcactctccaaggcacagctcaaaaattgtttcaagcaatggaatcttcacgtgaatgggcacatggcctcccacagcaaggatgctcgttaatggggaagaatcactgaaaatccgaattcagatgtgtttcagaaagcagcttcaaagtgtgtgactgatcttcctagtcctgggaagagcagaattggcccttagaaccgttaagagtcagattgtgaaacagagagttcttgttccccatatgtttcactctaaatggaacatgaatcagagctgggagaggagcttccaacttctgtcaataataaaagccttcttatgagtcaagt

SEQ ID NO: 259019 - DNA, 156 bp, Homo sapiens
ttgaaacagggtgtagctcttttgcccaggggggagaatcacttgaacctgggaggtggaggttgcagtgaaccgagattgcgccactagactccagcctgagagacgagcaaaactgtctcaaaaaaataaaatgaaatacataaataaatgtgc

SEQ ID NO: 259020 - DNA, 363 bp, Homo sapiens
cacacacacacacacacacacacacacacgcatacacacacacacacactctctctcttacattttctaattttctggctctgttttctgaaagggcctagaacttttgacaccacagtaactatgaacacatgtagcacccagatcttggtttctaaatactgctacccacaaaaaggaacgagggcttcctggataaatggtggattccaggtctgaggctgcaagtgttgctacagaaagcgaggaagtgctcaaagaatgatggagacaaaggaactggcttgaaaggaaatccactggctgcattgggacaatttgagcattaagaaaaacagcaatggattgtaacacattaaatta

SEQ ID NO: 259021 - DNA, 408 bp, Homo sapiens
atcaaagcaattagttagcatagatcttagaaaaactgaaataatagaaccactggatgctctctgtgatttgtgttgctccactgatgcctaaaccatagatgccttttcagatttgtcaatatctccggttgtatactaactgttgagtcagtagaggagcacacatagacacatgtcatctggcctttcagtgacagaatagaccaaatgtttttatcctgctttggctctccagcttcttgctggcctttgaagatgtcatgaggccagcccattatggccacatagcagtaagctaaaaaaagtatagataactaggacatgatctgtattcaaaagtgggcttacatctcctgtcaaactgagatttgactgtcttctagcttttaacatccccaggtgaca

SEQ ID NO: 259022 - DNA, 329 bp, Homo sapiens
aaccaagcttagctgcattttgtcaatggcatattgaaaaaaaataattacactgttttttactgtctacaaccttcaggtagtggatagaatgctgggcttgtagctaacagcagcagcaacaataacaaaagtggcacccttctcagtttcactatcccatcaccatgtggtcttgttcaggccactgaactctgaaccttgttctctcaatagaaaatgaggaggctgagcttgaacttggagagctaagcactttcttgttgcatctctgaatggaagcttgcatagcagggcttttcaggtaaagatgaaacaggggtgggagt

SEQ ID NO: 259023 - DNA, 429 bp, Homo sapiens
atttggttttactgaatgattcatcagctatgccgtgaaacttagaaatatcaactcttgggctcataagaacactttattatcttcattgtcactagttattacttgagatattgcaatctaactttttcttcaaaagactgtgtttttctaaacatattcaacccagcctagaccaaattcatgcattatttttataaagtacaatatgttctgctaatatctccagaaaattttttcttgaagttgatttatatgtaaatacttttacaacatgaatttcaccctaattgacttcttataaggcaagaaaatgcataaatttttcttaacttttactagcatctattccccggaatactccaatcacttatgaataatatttcagttctgtattaaaaatttctctgtgaagcttgctcttggatt

SEQ ID NO: 259024 - DNA, 455 bp, Homo sapiens
ccgtgtggcctctctcctgccgatcagagcagcgtgaggtggttgggaaacaacacctctttcttaacactccatcaggttgattatttggtctgtaatgactgaaagcagtaattagaaatttcttctgttcttccgcactgtcgtgggcaccactctgtgcagatatgtcagattcctaaagccaggcttttggcaagagcccttcctgaaacattttctttggtcagtattttgacacagactgcctggtggatgtccaatatgaggtacaaaaacaaactcataactagccatggatagtttttttttcttccagccttccactttaaaaaactcccttttctcccacctgtgatccacttacttgagggttggtgacatggaccaccctgaatctattttatttacctgtatcattggagtgcttgtaccaattataatgaaagaaaaaa

SEQ ID NO: 259025 - DNA, 312 bp, Homo sapiens
ctcatcttcatggatttactttcgatgggattttttttttatatgtgtgtgggggtcctttttgttgatgttgatgttattgctgtttgttagcttttcttctcacagtcaggcctctctctgcaggtctgctgcagtttgctggaggtccactccagactctatgtacctggatatcaccagcggaagctgcagaatagcaaagattgcttcctggtccttcctctggaagcttcatcccagaggggcactggcctgatgtcagctggagctctcctgtatgaggtatctgtcaactcctgttgggagatc

SEQ ID NO: 259026 - DNA, 396 bp, Homo sapiens
accaacatggagaaaccccatctctactaaaaatacaaaattagccaggcgtggtggcaagcacctgtaatcccagctactcaggaggctgaggcggaagaattgcttgaacctgggaggcagaggtacagtgagctgagactgcaccattgtactccagcctgggcaacagagcaagactctgtctcaaaaaaaacagaaaaagaaaatatgaaagaggagatgagtagattagatggtctaacatacaactacttggagttccagaaggtggtagaatgaaggactggtccactgaacaaattaatagctgagaaatttccagaactgataaagaacacaaatctgtaagtagaagtctaagtcgacgcggccgcgaatttagtagtagtaggc

SEQ ID NO: 259027 - DNA, 1004 bp, Homo sapiens
aattcgcggccgcgtcgacgagagtagggaagcttcaggatagagtgggaaggatagaggatagtgtgatcacacagagaccttccactgaatgacctccctgactgtcaatatctgatggtctttcctctggatcagcttactctttacttgggagttataagataggctgctagaagacttgcaactaagcaaaggaagggagccagttcccttttttaattatgcagactttcatttaatcctcacgttctttgtacagtccatccctcaatcttccttaccagtgtttagtatgtggatcctgattttttttctaaaaatgaaaggaggagaactagtgtacagctgccgggtggtctaagtgtcccttacaagcctaaacaaatcctcaggttcagcacgttttatagtccacatttagagtaactggtactcccaatcagggggttctgcttaggaatccattgcctcctagcaactctcctaaagcacctataccttctccataccactagtagttacaaattatgcatctgcatcttccaaaaatgtatggatatttattagaccctctctactattcttggctttgcaaatttatgctttctgccatattaacagaaagtctcaagtgaactatttaaggcaatataagccacttcaaagatattctccatttatgctggctaataggccatacacccagtttgtactcttcggccaagaagggatagctcagtgaaaaaaaatttgagacatactgactaaataaccagaatctctgatattaaaaaatgaatgaaatacgattatcacaataaaatgtccttttttctttgtcaatcaggaaaattttattttatttgactttctctctccccctcattataggcttcaaaactcattatatccatatcttgatatgttttcccaaaacttcctttacagctctctctctaaataacatatttctccttctagaatttaaacagggtaccaac

SEQ ID NO: 259028 - DNA, 453 bp, Homo sapiens
ccgggggcagcagaggcgattgaggggtatcccgttaggcatgggaggcccaagcagaagggtttggccccgtcctctcactgaaccccacagatgtgcctgtctgcaggcatctctagtcccgttttccagagaaacactgctgctggggggcggggaggggtgaggtcagtgggcctagatcatacaaggagccatacccaggctgagctggatggggaggggaggtagcctggcacccccagggaccaagtgtcattcagtttgttgcctgatctctcagcactcttctgtgatgtcccccttaggacagtaggtggtcctgggacccacatcaggagggggtgagggcaccggggcctccatgatgtccagcactgggctccgactgccactgaggacacggtgccccccgggacctttgacacccgggggtctgaggggccctggcta

SEQ ID NO: 259029 - DNA, 337 bp, Homo sapiens
aataaagagactaaggaagcaaagcgtggcgtgcttgtttatcactagccaaaggtgtgtgcctgtcccagtatgtcccaggcaggggccattgagtcacttagcattaagcagcaggacgggcctaataccgtcaagagccatgattaaagatgctttgtaaaacatttctgaaacagtgataattggcttgattactatttaggcctgtgtatattataaatgctcattaactttacttcaaatatcattgaagtggttatttaataacttttgagagtttttgctgacctgatcttaataaaatgctgtgttaataatggactttgctcagttc

SEQ ID NO: 259030 - DNA, 296 bp, Homo sapiens
gaaagacaactaatgtaagaaccaatctggaaaactatcctgaccagatactgttttttcagaatcccaaaaaaaaggacataaagaatgtcataaatgctgtaatctagttaataaatatgtttcacacaggggtttgggttagcaattcagaaattactttttgtttataccagaaataagcaaaattttctccttggagatgtattaaacctaaagctgggacaaggaaaaccatgatgatcctggaaaatcctatggtgccagaaaataagaaagtgaccaaaaaaaaaaaa

SEQ ID NO: 259031 - DNA, 498 bp, Homo sapiens
gggatcaaattcattttttatgagaaacctacttctgagacagtagcattaaatcattcataagggcacagccctcatgggctaatcacctcttaaaggtatcacctcttaatacaattacaatgggaattaaacttcaacgtaactttgggaggggataaatattaaaaacatagcaatcacaataaaactgggaaattaaaaaaaaattgtgcggctgggagcggtggctcacgcctataatcccagcactttgggaggctgaggcaggtggatcacctgaggtcaggagttggagaccaacctggccaaaattgtgaaatcctgtctctactaaaaatacaaaaattagccatgcatggtggcatgtgcctgtaattccagctacttgggaggcagagacaggaaaattgcttgaatctgggaggcggacgttgcagtagagccgagatcacgccactgcactccagcctgggtgacagaacaagactgtgtctc

SEQ ID NO: 259032 - DNA, 501 bp, Homo sapiens
accaccacttaaaacaatatagaacagacatcctaccgtgtttcttacatgaggatctatctcattctttttaatggctgcatagtattcaatagtatggatttaccataattcatgtaatcattaccaaattgaggatatttgagttatctccagcttttcacaattaaagtaatgctgtagttaacatgcttttacatttatccctgcacatttgttcaagtatttttgataattttccagaagaaaattgttgtgtcaaagtatatgtacaaaatacatgctaatttgctttctaatttaccctgagagtaccccttttccatatcttttctaatactagatattatttgtctaacttttagcaatttcttaattttaatttcctaatcattagtgatgttgaacgtcttttcatgtgcttactagccatttacagttctgtagattgcctgttatagacatttctaaggctcttgacaagtacaaccatattttttc

SEQ ID NO: 259033 - DNA, 140 bp, Homo sapiens
  misc_feature (127)..(131): n is a, c, g, or t
  misc_feature (133)..(133): n is a, c, g, or t
  misc_feature (139)..(139): n is a, c, g, or t
cctggccccagggctggctccacttccacgctccttaccaagctacccttaccaagctacgggtgcaggaagcctttagatgcctcgctctccctgcccctccacacttggtatgctgtgtccaccnnnnnanccctanc

SEQ ID NO: 259034 - DNA, 164 bp, Homo sapiens
ccttgggggctgatcaataatacccataggctggcagcaaccttcttctgttgctgctcacctgggctgtcctatttggcttcagctcttttgttcccggtgcaaccaattccctgcattaaatttcttctgtttgaaatacctggagtggattctattttcct

SEQ ID NO: 259035 - DNA, 1433 bp, Homo sapiens
  misc_feature (245)..(245): n is a, c, g, or t
  misc_feature (364)..(364): n is a, c, g, or t
  misc_feature (1062)..(1062): n is a, c, g, or t
  misc_feature (1182)..(1182): n is a, c, g, or t
ggccgctgtagtcactgccctggaggacgtgttccaggccctgggctttgagagctgcgagaggagggaggtcccggtccagggcttcctcgaggaactggcttggttccaggagcagctggatgcccacgggcgccctgtggggtgtgccttagtggccttgatgcccccagagggcagctgaggcagccacagcagctggtccgggagctgagcggctgccgggccctgcggggctgccccanagtcttcctgctgctctcaagtggtcctgggtcctccctggagcccggagccttccttgctggcctgagagagctgtgtggccgctctcctcactggtccctggtgcagctgctgacgnagctcttccgcagggtggctgaagagtccgcagggggcacctgctgccccgtccttcggagctccttgaggggggcactgtgcctgggaggcgtggagccctggaggcctgagccggcccccggtcccagcacacagtatgacctgtccaaggccagggctgccctcctcctggctgtgatccaaggccggcctggggcccagcatgacgtggaggcgctggggggcctgtgctgggccctgggctttgagaccaccgtgagaacggaccctacagcccaggctttccaggaggagctggcccagttccgggagcaactggacacctgcaggggccctgtgagctgtgcccttgtggccctgatggcccatgggggaccacggggtcagctgctgggggctgacgggcaagaggtgcagcccgaggcactcatgcaggagctgagccgctgccaggtgctgcagggccgccccaagatcttcctgttgcaggcctgccgtgggggaaacagggatgctggtgtggggcccacagctctcccctggtactggagctggctgcgggcacctccatctgtcccctcccatgcagatgtcctgcagatctacgctgaggcccaaggcagctcctgcaggggcacccctccagggagctctgaccaagcagacatcctgacggtctactcagccgcagagggntatgtggcctatcgcgatgacaagggctcagactttatccagacactggtggaggtcctcagagccaaccccgggagagaccttctggagctgctgactgaggtcaacaggcgggtgtgngagcaggaggtgctgggccccgactgcgatgaactccgcaaggcctgcctggagatccgcagctcgctccggcgccggctctgcctccaggcctgagggtgcggcggccacgggggcgctgctgagacggtggccagatcccagcgccattcttgcctccatccaccccccatccccccggtttcctcatctgagagcgaggcgtggcagcgtgggggtggccgtgcaataaatatctgccgtgaacagtg

SEQ ID NO: 259036 - DNA, 1131 bp, Homo sapiens
  misc_feature (245)..(245): n is a, c, g, or t
  misc_feature (364)..(364): n is a, c, g, or t
ggccgctgtagtcactgccctggaggacgtgttccaggccctgggctttgagagctgcgagaggagggaggtcccggtccagggcttcctcgaggaactggcttggttccaggagcagctggatgcccacgggcgccctgtggggtgtgccttagtggccttgatgcccccagagggcagctgaggcagccacagcagctggtccgggagctgagcggctgccgggccctgcggggctgccccanagtcttcctgctgctctcaagtggtcctgggtcctccctggagcccggagccttccttgctggcctgagagagctgtgtggccgctctcctcactggtccctggtgcagctgctgacgnagctcttccgcagggtggctgaagagtccgcagggggcacctgctgccccgtccttcggagctccttgaggggggcactgtgcctgggaggcgtggagccctggaggcctgaggtgaggggggcagggcagggatccaatcacatggccacagtttccagtgggacagaagcttagggggggccccggccggggaggccaggagctggagtcctctcaggccactttagatgtgtcttaaccctctctgcagccggcccccggtcccagcacacagtatgacctgtccaaggccagggctgccctcctcctggctgtgatccaaggccggcctggggcccagcatgacgtggaggcgctggggggcctgtgctgggccctgggctttgagaccaccgtgagaacggaccctacagcccaggtgaggggaagccgagaacttccactggtgctctgaaggaagaccacccctccctagaaacctggggcctctctccatcactggcaggaagtgcaccacaagtctaacctctgtgctccctgttgcctgcatctggcccgtcacttccctgcctctggaagcctggtctccagggtccccgaggccttcctcactggctggttctctggcccccccgccccctccccagctcaaagctttagctccaagtcttggtttccctcttggctcccagcagcccactccactctcctcacacctctcaacttcttggtgcggcttccccacgagggcaggaggagaactgg

SEQ ID NO: 259037 - DNA, 352 bp, Homo sapiens
gcaagaaaactgtccttcatctgcctccaacatttattagctctgagaccatgggcaaggccattcattaactttcctagactctaacctcatctagactcatctataaaacaagacaaacattccccttaatgctttatgaggatgaactgagatactgtgtagtttctggactcatttaatcctaggagatgaagggatagaggttcccatttaatgcatccagacttctggaatagtctgtgggaactcagagggcctttcaatatctcttctttattctttcaagactggtcactggcacctggaaccgctgttggtactgacaataaaatggggaacaaaacatcca

SEQ ID NO: 259038 - DNA, 191 bp, Homo sapiens
tttttttggtagaggagatgaggtctcactattttgcccaggctgatcttgaactggcctcaagtgatcctccggttttggcctcctaaagtgcctgggattaaaggtgtgagccactgtgcctgaccttatttgagctttttacaatgagaattattcatgcattactagactgattttacatttaatag

SEQ ID NO: 259039 - DNA, 648 bp, Homo sapiens
ctaatttttgtatttttagcagagacagggtttttccacgttggccaggctgatctcaaactactgacctcaggtgatccgcccacctcagcctcccaaagtgctaggattacaggcgtgagccaccatgcccagcccaagagcagagttggtttttttcctgcatacacctagatgcttttgatgatcaaacaaatgtatgtgacatgggttggctattttatactcctttttcagtttaactttatttaataggttctggtagattagcatagccagtgaaccaagaaagcgttgttttccttccttctgttcctgggcctgaatatttgccctaaagtacaaagaatgctcctgtggtaggattgtcatttttcctcggggcttgaacagagctgtacattccagatgtcccacagtatcagctgcccccttcatctagaagtttggctgtcacttgtatatagtgatgggattaaacaaagtaactcgttgaagcatcccagatgaataagtggggagaataagttattaagtatctagtgggaactggtttgttaatctaacttacaagaatagtggttctcagttccatgattacctaatgactagcaatccttagccctgcagaatagctgcagaccaaaa

SEQ ID NO: 259040 - DNA, 279 bp, Homo sapiens
cttgggaagacagcagcagagagcattatgagctgagttagagagtcacaggctccctctgaaaccttctagcagatttcgcaaatgctaggaggccagaatagcactcctggtgttccagccatgttaagaacccagagagaactctgtgaaactgctccgtgggccagtggctcagaacacattgtagaaatgatctgtgggtagcagtgcacttcctttaggcagagtcggaagagccaagttagtgaatgccccaggccccacagcgagacctca

SEQ ID NO: 259041 - DNA, 454 bp, Homo sapiens
cgcagacggacgggcctgaatcgttcgccttgcggtcggtcctatcaccctgaaatgggatccagcatcccatcaccctgaaatgggatccagcactaccaactgcggtagccgtggttaaaggagacgaccccgtgcagcaggaagaagttatttagaataaggaagaatgcgccgggcttgtttatttacgggcataaatttttcgtagggttcgacggtatggcggctccagtctcagatctcacagaatttcctacacaaagaaatttgcaaggaaaatggacattgcaccctaaaaattaacaaggaaagaaggtaccaggagcaacaactcattaacaggaacagaaacaatattgcaaatatttcagatgcaaagtgtatccgacttataatacaactgtccctactgtgtctaaagaaatgaaaggcaataaagaaaatatctttg

SEQ ID NO: 259042 - DNA, 430 bp, Homo sapiens
gttatcatcactcagacacccttcaggatgactgacgttattcttacagaacagggatcctcgattgtttggggggatgcatcacttaactctttccggaatctgttgatagcacaggaaattttacaaaattgatgtgtgatttcaggggatttatggatcccagccaagacccctgttaagagtttctcttacagaggaaactggaagggtcttaaagctcggtgatgggtgacgtatctccaaataattgttttctgaccctcaactcccagcacttggtggaaaatgaattctgactggagagtcaatgctagttgatgatataatcggtcactattttttcccaccgcctcacccaatcccctgactgggcccccaacttcctggtgggttagaacacaaactatttctgagggaaaataaaaag

SEQ ID NO: 259043 - DNA, 295 bp, Homo sapiens
ctccgcagtgggctgcagcacccgtgacaccgtgctcagccgggagcgcggcctctccttccaccaatttccaactgataccatacagcgctcaaaatggatcagggctgttaatcgtgtggaccccagaagcaaaaagatttggattccaggaccaggtgctatactgtgttccaaacattttcaagaaagtgactttgagtcatatggcataagaagaaagctgaaaaaaggagctgtgccttctgtttctctatacaagattcctcaaggtgtacatcttaaaggtaaagca

SEQ ID NO: 259044 - DNA, 337 bp, Homo sapiens
ctcctggctcctgagagaaggctggatatagaagataatgctgccatccattaggagaaagggaacgctctatggaacccagcagttctccaggacacctcttggtacttccactgaccacagtaaaagttcataaaaaactaacccaaccaactaaataaccaacaaaggcaggaccactaagggtttggacccttcaggaatgaaggttttgatcaccctactggtaaaaagccagaacaatggaagggtgggctcaaggcaaatggaacctgggatgaataatggaagaaggaatttatgaatattaactacagccttgtgaccagttacagaa

SEQ ID NO: 259045 - DNA, 771 bp, Homo sapiens
  misc_feature (125)..(125): n is a, c, g, or t
  misc_feature (770)..(770): n is a, c, g, or t
aaagcgttctcggcggcagcgcaacaactagaaccgtgagaacgcgtccagcaaccgcgaccacgacgacgtcacctcgggcacgcccaaggagaagaaagcccagacctctaagaagaagcagngctccatggccaaggcgtagcggcaggcgtcccccgcagacctccccatcgaccccagcgagccctcctactgggagatgatccgctgcgacaacgaatgccccatcgagtggttccgcttctcgtgtgtgagtctcaaccataaaccaaagcgcaagtggtactgttccagatgccggggaaagaacgatgggcaaagcccttgagaagtccagaaaaaaaacagggcttataacaggtagtttggggacatgcgtctaatagtgaggagaacaaaataagccagtgtgttgattacattgccacctttgctgaggtgcaggaagtgtaaaatgtatatttttaaagaatgttgttagaggccgggcgcggtggctcacgcctgtaatcccagcactttgggaggccgaggcggtcggatcacgaggtcaggagatcgagaccatcctggctaacacggtgaaaccccgtctctactaaaaattcaaaaaaaaaattagctgggcgtggtggcgggcgcctgtagtcccagctattcgggaggctgaggcaggagaatggcatgaacctgggaggtggagcttgcagtgagccaaggtcgcgccactgcactccagcctgggcgacagagcgagactccatctna

SEQ ID NO: 259046 - DNA, 510 bp, Homo sapiens
accaactggtggtaaacaccgccaggacagggacactgtcttcttcatttgtagcaccagagcctgacacatagaaagcacatgaatctttgtgacccaaatagaacaggacgatgtttatagcagccagatgcatagtacagaatgagcctttaggaattttagaggaaaggactcagagactgttagatgtcctaaaggggtttcatggaaaaggagggcatcctagatggaactcagttggagaggaggaatcaggagacactctcagacaatgtgtggcatgagcaaacaaagcagagtcacccaaggtgtgtggagggtctgaagcagaccgctattgaagcgggatgatggcaagtgattgggtcagtttgtgtgaagaattggcgtttgatctttaagggatggcgaaatcactggaatgtcaaaccctagccgttattaaagtatactatactgtgcttcagcatattcccccacaaataaaaggaagtatcagtacctaca

SEQ ID NO: 259047 - DNA, 216 bp, Homo sapiens
acagagcatatttaaggggactagaagacagactcacacaattgcctccctcttttgtgtgagggagggtcaaccactttccatcctcctccaattagtccaaaaaatactcattaacctcctgtccattgcaaggaaaacagatgatcaacatgagaagctcagctgttgattaattttcccaaacagggccaaactacaaagcagcatattgca

SEQ ID NO: 259048 - DNA, 418 bp, Homo sapiens
cagaaacagaaagtaaccattttttaaaattaaaatcttaaaattgatatggtggatacttttactgaggtggtccctgcctcaaaagttgccactgctgggcaactcactgtcctctcttaagtcatgtgactttctttagcagtggaaatacttagtgcacctcatgagtcttggagagtttcgttgagttcctttgctttgcaatgagaagatcggatccaggttgaggttgagggcgggtatatgtgctttgtttccggcctcatatttggcctctaggtaaatagaactccacatttcaaggctaccaaatctttcatggatggttaaatcccaatccctcccccactccagggtcaggggtggaggaaggaggagaggtagaacaacagggtaaactgaaaacaatcaatca

SEQ ID NO: 259049 - DNA, 466 bp, Homo sapiens
ctaatattttctccccgtggggtgaggcagttgaattattcatcatttctgtttatggacctttggtattcagcaaagcagaggcaaaaacttagaaagagcgctatgtccagagatcagtattctgaaagggcacttgtcaagtggaatttcttatttgctgcctgaatcttcagaggagacaactgaattaattaataaaacaaaataccagaattttgggaggccaaggcaggcagatcacgaggtcaggagatcgagaccatcctggctaacacagtgaggccccatctctactaaaaatacaaaaaattagccaggtgtggtggcgggcacctgtagtcccagttactcgggaggctgaggcaggagaatggcatgaacctgggaggcggagcttgcagtgagccgagatcacaccactgcaccccagcctgggcgacagagcgagactccatctcaaaaa

SEQ ID NO: 259050 - DNA, 416 bp, Homo sapiens
ctccgtgtgcaggaatgccaaactctccctgccgggaccctccgtgtgcaggaatgccaaactcgccctgccgggaccctccgtgtgcagagccctggactggactcagcctccccgacaccgcccagagctggtcatctcccctggggctgcttgggcgtctcagaaataaacgccccagtgtgcagactccacctgaccccattctagaaccctctttcagcctgtgctctcccatggacccctcggcctccagcccaggcccgggcaggggccgcatctatgcagcacagcctgcacagacatcgtttgggtctcggaggctggcgttacccttggttgctggacatggggggcgtgcagttatgggggcgctgtcagccttcccgcgcgcatcgccgactccacgtggaccc

SEQ ID NO: 259051 - DNA, 259 bp, Homo sapiens
gagctcaggaagagaggctgcgggtggagaggggaggaccctcttcccaaagccaagcagaggaaaccaagtttaatagagaaaatatctaaagatgaaagggaggaatcatttggagtgcaaatacatgagagaagagtggaagttgagacacttgaattaacccaggaaacaagagagaacaccacaaggaaaaagagatagaaatacaggaataaaaataaaaacgagatctgtttctggggaatgtaaaaaagaa

SEQ ID NO: 259052 - DNA, 728 bp, Homo sapiens
gctccatcagtctttagtctaagaagtgatatataggatcatggtttgacatcatcttgtgctgattctggttggcttaatggaatcaaattggatgaaggtaattaaatatgaattgtttctgatgctaatagatagttgtacttctgtctgttgggtatgggttgggatgggcggtagcatagctgattgcggtgggggaatttcagatagctgatgatgtggctatctgaaaattgccactacatttttaaaactgaaaagtgatggtaccgccaaatgaaatctgcagcatcctcagactcaatcaggaaatacttaagcattatgctccagggtggttttcttcccttacattgcaactggactccttgaggcacctttttagaattagtgagccgctaggatttttatactatgctttgacataaaagaaagttgcttgtcaatatgtgtttttttagtttaccagcatatcagatctcacaaacaaattttaggctcggattggatgtttctagtaaaaacaagaaaatccaggcatcactaaaagaatcagaaatacgttgtggcttgaaaggtgcaaactaaataatatagctagcagtaacggtcaccaactcctgcttttctttggttcagtagatagagtaaaatggaaaataggaaaccaaggtcagtccccaaatctcattttaaccaatagcagcaaaaaaaaaaaaaaaaaa

SEQ ID NO: 259053 - DNA, 332 bp, Homo sapiens
ctgttgcagcacaactgtatcttcctagtcgtgttcagcttcaactaaaattcacatgtaaggatctggggttggggaaagattagggagattagagctgccatagattctgacgagtctttcccgggccttctttcatcttttcttcttgatttcttttcttctaaaaatctcctgctcttttcccaaaagaaaatcagtctgctgccagaaagaatataatacctgtcatttaaacctcagtgtaaaatggcttaataatagtgaacatttgcattaaccgttttacagtttacatagtacttttaagtacattttctaacttaattctc

SEQ ID NO: 259054 - DNA, 847 bp, Homo sapiens
tgcaatatatttgtaataagttaattctacttaattatctcagcttgtcaatgttgtaaacttaaaaaaaaaaaaatagaaatgcaccagttggtggaaagaagggagggatcaaactcatcgactataaccgtgcaggcctttacctcaacttatttcaagtatctcttattcctacagtgaagtgctggtgctggctcctaccaatcgtcaaagagcaagttgttaaattttcaggaactttttgagctggctgttaatagtttgaaattggccacagtggaagtactaacactacagaaattggaaatcacaacagaattggcaaacgctgtaaaatagagcttcccccaacccccaacaaagcccattgttaaacatttaccaacacaccagtctttgtatcctttagaactgtgttatttgagaggatatcctagatacataaaatactgtaatgagattgactataatctcactgattgaagaatattgatcattttccttttccacgttctttttttttttttcttttgcctgcctggaaactgacaccctttccacattcttaaatgtcttcctttagggttgtttgaaccccctatccaattcattgctggatatatttgatgtttctacagaacttcatttgtgaagatatgttacttttaggcattagcctagtgatttttttttaaacttttttcttcttcatcagattacccagattaagaagtatttcagtaaggtggcaaagttttagaaattactgaatctggttgatacgtatataggtttattatactattttctctagttttgtgtgtgcttaaatttttttataatt

SEQ ID NO: 259055 - DNA, 401 bp, Homo sapiens
caggaaacgggattctggcttctatggccggtcttggagaagaggaattctagtttctatggctcacctggggaagaatcagggtcaacagacaggagggcagagaaactttgcttctgcggccttcatttggggtatcattttttgggctccagcgttaccttcacagcaataacaaataactaggttttgccaggaacttggcaactctgagaggattaaagcaagactgctgccaacttctgttgcttccttatcacctcaagtcgtctcagattaaagtctctgatagttgatctcaaggaattacacgtagcaattgggaagcacatttttatttgcttaagcttctaaagtctaatgtaatgtcatttgcacaaataaaaattaacggttggtca

SEQ ID NO: 259056 - DNA, 541 bp, Homo sapiens
gaggtcaccacacaggaggaggagctggtaagggcctgcattgcccattaattttgaggatttatggtaccctggaaaccaaaaggacctttcggccagacaccaacacatctctcaggagcacaacacagggcagaagcagccgggatgtggggaccgcgggctgtaaactattaatgcaagatgccaggggcagcacccaacctccagaggtttttcccgctgatctcagtgaaaggtaggcactgacagtatccacagtgtgagagggcaggggctccttaacagttacagatctctgtatgcaaatgaaagtacacaaagccagacacttaggaagaaggcgcttcaacaggcacaggtgttactgcttaagccaagacagatgagtataatgtagagaaaccctgtattacaggagggattaagccagaagggtgtttgtgggagggaatgaaccttcccttcatcaaaaatcactgcaaactgtgtgcataacacccatctgtgtgtttaaaataaaaaatttcatttactaata

SEQ ID NO: 259057 - DNA, 474 bp, Homo sapiens
caaatattttgcttcttctcctgagcacatggcagaattaaactttttgtatgcacttgaattttggcatagccatgtgactctctttgtcccatgaagatgtgagcaggagtgttgtgtatcactaccagaagaaagccttaagaaccagtgtatctgtattacattttatttttctctgacatgcaacttgaaatgtttcagatgatggttacattgtccttggtcctggaataagaaggacatgaaggaagctcacaggtagcttaggatggacatgctatgtgggcaagaaataagcctttgctactttaagtccctaagttgtagagattgttcattatcacagcattacctcacttattatgtctgacttatttgcaaatcagaagctcttatgccttttcttaaaatatatgccaataccaaaatggcccttttaaaattgagtttgtaatttaaaactaattttgt

SEQ ID NO: 259058 - DNA, 460 bp, Homo sapiens
catttcctccccttgctctttgaccacacatcactacacattggtatgccagatctctgccagttttagaatgtatattgattgtgtcttcctctgtctttgttttaaatgaaatagatcaggcacacaaaagtgtaaagagaaaaaacaaaaaaatgtaaagagaaggaatgaacactcatatatggtgttttttgttggtttgttttgttttgtttttcgagacggagtctgactctgtcacccaggctggagtgcagtggcacaatctcagcttactgcaacctccacctcccaggttcaagcaattctgcttcagcctcccgagtagctgggactacaggcatggtggttcacatctgtaatcccagctacttgggaggctgacccaggaggattgcttgagcctggggagccagggaggttgaggctacagtgagccatgattgcaccactgcac

SEQ ID NO: 259059 - DNA, 291 bp, Homo sapiens
gaggttttgcaatttataaaattgggacaatagtattatccccatagacttgtagggagagttaattaacataatacatgaaaagcaccaagagaggctctggcacatagtaggtgctcaaactgcaaaaatatgtccatgtatctgatgagtagaaatgcacattctgtgctaattgaaataatcatttagtaggcagagttgaatggatgcaaaggaggagggaagggatgttttacatgtaactaccctgcacaaagtaggactcgccggatctcctctctgggttgt

SEQ ID NO: 259060 - DNA, 315 bp, Homo sapiens
accaagcattagaggcaagtggaacccagaacaagggtttccaactatgtctaacagaagttctagagggagaaacagagaaggtggagagaaggaatatttgaagagttatcagctgatgatcctccagaattgaagaaatatattagctcttatatcaacactgtagcttgagttccaagaaagataagtatcaacaaatactcacatgtgaaggagggaatcaacatataagaagctgagaaatcaagcaatcaatggagaagaatagtatttaaaatataaaagaataaaatataatatacccaaataaga

SEQ ID NO: 259061 - DNA, 517 bp, Homo sapiens
actctttttttccaccttgatactggtctcacaagggtcagctccctggtgtggtgtctggggtccctcacacagggaatgctgagagattggctttcaacggcaaacatatgttagagtgtttgatgccttcacgttgacagaacagagagttatagggactttgaattacgaaagggactctggactagcctgggcaacatagtgagaccctgtctctacaaaataaactttttaaaattagcatggtggcatgtgccagtgatcccagctactcaaggggctgaggtgggaggatccttgagcctgggagtttgaggctgtggtgagctgtgattgcaccagtgctctccagcctgggaacagagcgagaccctgtctcaaaaaacggaaaacaaataaagagaaggggtttctgctagagaaagagctgcccacagagaagttagtgaaatgacaaagggaattaaaataaaataataaagcatatataagagaaataaaagaataattacta

SEQ ID NO: 259062 - DNA, 1019 bp, Homo sapiens
aaaacttttattaaagactttaataattcataaggggatattaacaaaattcgaaaatactgctgagaactcctcattctaaatacaaaatgccattctgacatttttactaaacaaaagagagatctggcaacaacatcagattttcctgtacaattactttcttcatataatatatatatggttaattttataatactaaatagtaacaaatgctcaatgagaaaggctataaagccacttcagattatgttcaactatctattgactgtttcttgctgttttacaagtattaagtacagattaccttcccttcaaaaggtcaaatagcgtttagtgtttagggttaaggtttcttataatccacttatagtatcttttaaaaatattttgttgctaaacggtctaattttaatatttaatttttaatagtaagatatttcaacatggcttttttgttgttgctgttaatctgccaaagtgtgacagatagaacaatggctttagaataagtaagagccaggtttgaaacctgtcttcatcatttactagctatataatcttggagaagttacttattatctctgagctttacttttttcatctataaaacagggacaataaaaacaacttcatgctgctgttaatgtggtgaaattaaatagaatgtgtggcactcctaacaaagttacctagcatgaactagacagatttaagttcttcccgcatgattccagcgcttccttaaccccaaatactggatggcaattctgaagtcccagagaagagggtagaagatcaactaaaattgattttattttcttgttttgaacaagcagtggttttattaaacatacatttttggtgcctgctttttgactaatgaaaagagaaacttcatatattattgccaaaacaactaaaaaacatttatcaacttcttttgtaaactgcttgggaagtgttaaagcctttctagaaagcagtttggcaataagtatcatggacatcatcttgta

SEQ ID NO: 259063 - DNA, 632 bp, Homo sapiens
gggagaagcaagaactcaagatgacaccacatttctgacttgagtaacacagtactctttcccagaaggaagagcagattttgccaggggagatgagttgaatttgagtgtgatgagttagagatgccgtaaagtccaatgggaactgtcatctgctgctggaagtcagagcatgtggtctgctggagctgtcttggacggctggcaagagtggaccatgcacacctcacctcctcccagctgctttcagtgacctcatgttggtagcttgaaatcggctatggtgggtgtatttataccacagacattggcaggtgctctatgaggcagggctctcctctccaccctcccccactcagctaatggttaaacatttgccggcaaggagtcttgttggtgagggaggcagaatgaggctgcccctgggcagagacacaactgaccatctctcaagggtcaaataagagaagggagacttcttggtaggctttttccaacaagaatcttctgtctgtgtatttgcaagtaggagaaagacagggaggagtagacataggggtctgctttcagaagtggggacctccttcggctcccttttcactctgaccttgaattaagggagaagatttcag

SEQ ID NO: 259064 - DNA, 482 bp, Homo sapiens
ttttgttccgaacatttttcttcaaatagcgttgtgccagaaccttgtcattgtcccctaatatccattctccacttcttttggctatagaatccctgaattttaattagacagaagccccctccccattttctaaagacaatttccagcctcccttgcagcctgatgtgtccttgtgattacgctctgaccagtgggccacccagtcttctgttggcacagtggatgggggctgtgtcttatgaaagctatgtccaagagttccaagtggaggccagtagtgatggaaatggtggtcctaaatagagctgcaacctctgggtaaccctcttaccctaaatacatgttgcttacccaagagtcagactcctgagatttcatcattggtaactgatttccttggattacccattgttccctttattcagccttcttttaaaatgcaaatattcctgggtggataataaacatattgctactaa

SEQ ID NO: 259065 - DNA, 268 bp, Homo sapiens
tgaaagttataattattaaatataagctctagggcaactaataacaaaatatcttttaaaatatagtaaaagaggcaataaggaaattgaagtgatatactagaaaatgtctatttttaaaaaataaggcagcaatggaggaatcgaggaacaaaaaagacatgaaacacaaaccaataccaacatggtgaacataaatccaacctttccagtaaaagcattaaatgcaaatggatgaaacacttcattcaaaggacagagactgaca

SEQ ID NO: 259066 - DNA, 468 bp, Homo sapiens
gttttgctgttttgcattgaaattgtgcaattatttaggcattggcttattttgattgttaagaaatgatagtagggaaagttcatggtgatgaaatcactggaaggcaagaactactagctctgttgattaataaaagatttatagctctaaataactggtttttggtatagaccccctgcttttcttcacaaattatctgtaataatagccttgctagcttcataatattcacataccaattgtatacctttgccttattagtcttcttgccagaaataatgtacgttagtctaacctgtccaggttcctgagattcatagtgagtggataaaaagaagactactgttggctgggcacagtggctgacgcctgtaatcccgcactttgggaggctgaggtgggcagatcacgaggtcaggagatcgagaccatcctggctaacacagtgaaaccccatctctacta

SEQ ID NO: 259067 - DNA, 557 bp, Homo sapiens
ctgatactgtctgccttaaaattcaataaaataaaaattttaaatgaaaggatgagttaaaagtaatataagcaatctaataatctatgaatattttaaagcagagctaactcaaaagagaaagaaatgggagcacatctagggcaggtctctctgaatgtggatgacataaaccatgtaaaggtgggatttcaattcagtggacaaaggatgactctggtaataaacagtgctacccagtgggagaaaaagaaccacacctcacatcagattaaataaagagaggtggatcaaatggcctgcatatgtgtgtgcatcaagtagatgaagacatttaatagcacatttgtataatactggggagaaggaatcttaaaaaaagggtaaaggaaaacactaacagtttacataaaaatataaaattttctatgataaagataaagccatatcacatgaaaaatatgataaaggctcataatataggggatacaaccgcatccctaataaaatactgacttataagctgatgagaaaaaaacaatcagctcagtgaaaaa

SEQ ID NO: 259068 - DNA, 520 bp, Homo sapiens
gcctatatatgagtatccaaaatagatttcctatatatgatttggattaagagtagaattgcatttttaggaacattgacctgtaagatatgttacagtgattaattcattagtttcagtcactttttgaaatagtaagtgattgttaagatgctccaaggtaaaaatctgcatctttgcaggctaccatcaatattgtttttgatcgagttgggaaaacggatcctgtcacaagaggcattgagatcactgtgaattatctgggaatccaatttgatgtaagtgttatatcaagatcctggtttgtcatgtttctgttttatctactataacttaccattgttaagattctaatttgtatactttaggtacttgcttctgcttttgttcttcccactctgtatattttgacgtattcacatggaaaatttttatattttgatgtattcacatggaaaatttgtaaaaggccaagattctctctcttaacataaagccagaagtaatgattgatacttaa

SEQ ID NO: 259069 - DNA, 433 bp, Homo sapiens
acaaaggaaataaaatcagtacatcacagagatatctgcatttctctgtttattgcagcactgttgaaaataaccgatatggaattaacctgggttcatcagcagatgagtggataaataatatgtggcttgtctaaaaaattgaatactgttcagtcataaaatgccactacatgggtaaaactggaggacattatttaagtgaaataagccaggtacagaaagacaaatattgcctaatcccacttctacgtggaatcttcaaaagttgatctcacagaagtacagagtagggctaggcacagtggctcatgcctgtaatcccagcactttgggaagctgaagcaggaagatcacttgagcccaggagttcaagaactgcctgggcaatatagcaagaaaagaagaagaaaagagcaggagaatgagaaga

SEQ ID NO: 259070 - DNA, 371 bp, Homo sapiens
tatgaaacactggaagctcttccatcaaagtcttatggagagtgagatgaatggggaggcctccttgattcatgcctcctcggcataatcactgaatcagacacttcctgaatggataagaggttctgccaccacacaatctgaattcacacgtcatcctctctctctctctctctttgccccttccactctctcttttgctaagcatatcgcctttcctgaccaggaattagcaaacgggtccattgaccaaatccggcccaccgcctgtttctgtacgatccatgacctgagaatagtttgtacattttcaaatggctattgaatataacatcctagatgttgacatcctagatgttgcctcttagctt

SEQ ID NO: 259071 - DNA, 175 bp, Homo sapiens
ggacttcctgttggcccccacctccatgcacaactccagtgctcataggccttaaaattcgcccaaggaagccagtggaggatgtaggcctggctcagaaacagcacagctaaggggccattcccagcagtcctatgattggcgtttctcatgcaaactggatggtggagaaacc

SEQ ID NO: 259072 - DNA, 281 bp, Homo sapiens
cttaagctaactcaagttggtttgattacccacaactacaaattttttttaaatcctggacaaagatgctcacatgggtgtgcatgtgtgggggtgcacacacacacacacatttcttacaattaaaaaaggtttacagacaccttcatctgactagcacattagagcatatcttcccaaatgaataagttatgggaataccacaatattgatcatcttagctctcaatctaattttctgtttgtgtcacaatataaagaatgggaagccctaccacataa

SEQ ID NO: 259073 - DNA, 603 bp, Homo sapiens
ataaataatgttaaattaaactaaatttggtctgaggatgcctcgtaacttgagtcgctacataacaaactgcaacctaacttaggagtattttttttttgtactaacgaggtgagtctcagccaatcacagcagccaagctacagccaatcccatgtggccaactgatcagcctatgcccagtaagacaactgctcacctgtaactactcaagctgcttctggacctcatttccatttgctgtttataagtgctgcctgcccactttgctgagcagaactctctgaacttctttcgtttttgagggttacttgattagaaaattgttctttgttcaattaaattttgctaaatataattcttttaaagattttcttttaacaacaaagatggggatatttgaacaataccttggttggaggtgacattctaatttctaaattgaggctatttgtatttttagcaggacccaaggactgtcacttaaaagcaggctaaaaagccttgaaattttctaactttccatgcgagagcagtgatagataaccccactacgcaaaatgtcatggggcaatgggagacaaaaactaaagctgtgtttca

SEQ ID NO: 259074 - DNA, 290 bp, Homo sapiens
cttaagctcttttgcactcaagaaaaaaataagctcagtttaacacaattttcaatggccatctcaaagtcagataatgcacacaaatacatactacagacactcacaacctcctgagcgtcaccctctatcgcacagaacatgcgcagaaactcccaattttttccgtcccctagtcacatctaacaaaccagttccatgacgattcaatgaattggacagaaatgtccaccagggatgagaaagccacagaagtagaaaaatatccctctatgcgctagtcaagaagg

SEQ ID NO: 259075 - DNA, 908 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattc

SEQ ID NO: 259076 - DNA, 865 bp, Homo sapiens
gacagctctcctctcccctctagcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattc

SEQ ID NO: 259077 - DNA, 568 bp, Homo sapiens
  misc_feature (14)..(14): n is a, c, g, or t
  misc_feature (44)..(44): n is a, c, g, or t
  misc_feature (90)..(90): n is a, c, g, or t
  misc_feature (95)..(95): n is a, c, g, or t
  misc_feature (141)..(141): n is a, c, g, or t
ttcaaaggtttttnaaaggcaggcggcccaaggttgggggagangccgttccaaggtttgcctttaaattcccttccccggtgggtgaanattcntttcccaaacaagaacaaccctggtaacatcaccgggctgggggcngttttttataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 259078 - DNA, 903 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaagctgcagcaggcccggctgcccgtggtggactataagcactgctccaggtggaactggtggggttccaccgtgaagaaaaccatggtgtgtgctggagggtacatccgctccggctgcaacgtgactctggaggacctcaatgcccacagaggatggggctggcaggtcaggtgacagctgtgctgggtggtgcatccatctggagcctacaggtcattggagctccgctcacgcagtggggcccatagcagcataaacaggcagtggggggatcgacccatcgaagaaaagaccgaatcgaaaaaaaaaaaaagggggccgccaattaacgggggccggaagccgcaaccgacgcggccaaacgcggcagcacgtgacgacccccatgcccaaacgcgcggcagcgcgacgac

SEQ ID NO: 259079 - DNA, 337 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctcccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 259080 - DNA, 939 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 259081 - DNA, 883 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagacatagaagcatagaacaaggccagtggagtgtgatcgatccaatctgataagataagattctcg

SEQ ID NO: 259082 - DNA, 987 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcactgctccaggtggaactggtggggttccaccgtgaagaaaaccatggtgtgtgctggagggtacatccgctccggctgcaacggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagggaggatagagagacatgccagacaagaggctgcctggtgggggacagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 259083 - DNA, 659 bp, Homo sapiens
  misc_feature (1)..(3): n is a, c, g, or t
nnngtcctatcatcacaaaactcatgatgctccggctgctcagttccctcctccttgtggccgttgcctcaggctatggcccaccttcctctcactcttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggggtgactctggaggacccctcaactgccccacagaggatggtggctggcaggtccacggtgtgaccagctttgtttctggctttggctgcaacttcatctggaagcccacggtgttcactcgagtctccgccttcatcgactggattgaggagaccatagcaagccactagaaccaaggcccagctggcagtgctgatcgatcccacatcctgaataaagaataaagatctctcagaaaattcaaaaaaaaaaaaaaaaaaaaaaaaaaaaaac

SEQ ID NO: 259084 - DNA, 296 bp, Homo sapiens
ggaaaataatcaaaacaagaaaatagttttgtgacaggtgaaaaattatctgctattcacatttcagtatccatttgttgttttatttgaacaccgatgtggcagacagaattctaaggtagccccaatattcccatggcctggtatagacactctgtataatctctcctctactcaagtgtgggtgggactgagaatatgatggggtgtcactcccgtgattatgttactttttatagcaaaggtgacaagattttgcagatagaattaaagttcataaccagttgattttgagt

SEQ ID NO: 259085 - DNA, 548 bp, Homo sapiens
cacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaa

SEQ ID NO: 259086 - DNA, 368 bp, Homo sapiens
ggcaaccgcggctcttgctggaagccaggacccatcgatgaacttgtccctcctgggcctccagcccctgagaatgcaggtcccatgggactggggaggggggcactgattagccccaaccgctgggcacatttgcctggagcaccagagtcacccacagctgccttgattctcccccaggcttaggaaggaaacccaaaatgaaatgcggggtgtcggaaggtgaagtttacccacccctctccccttcccttccccaccccagagccactcggttgcaaccctgttcatgctcacctcaccctactcctccctctcctgttctatttttagactatttattgttttaaataaaataaagcaagtgg

SEQ ID NO: 259087 - DNA, 681 bp, Homo sapiens
gggcgggctagcgtcccgctgctgcgctggttccggagcccttcccttgcctctcccagggtccttctcccagcgtcggaggaaggcccgcagtctgcgagtggagtgcgggtggtgggaatccctgggaggattacgaaatccttaaagtgggatttaccaaacgcattcctttccgctcacttccgttcccgcttaacaaacgtgttggaaacgtgttgctactgaaaggaagtggcgctgggctgcattttctgtggctagtctgcgagaaacagccctggaatagggcctctatttcttccttggagcatccctccccgggacctgggagttgaaactctaggctaaagcaactgaagcaggcccaggactgggtctctgaaattcatggtgtctctacgctgagttaaactaagtttttcagaaaatgtctaactaggctaaagaccttgtgcttcagagtgttttgagaggagagtttggggaaaagggctctctctagaaggtaaatttgtatgggagatggggagtgtgtgtttacacggagtatcgggcgtctttcttatgggtggacattgtggataagaatgagatattaaggcagaattagctgggcttttaatcccaaacagtgttttaaaaataaaaactatatatttaaggtgtacaacatgatgt

SEQ ID NO: 259088 - DNA, 348 bp, Homo sapiens
taacaagtatcttggctttgctttgggcaaaccacttttgtctttgaatctcgggattcttatttatagaaactaggggttaaggttcctctcactttatgtgtttcaggatcatatttaaattgtataatctgttgtatttcaccgacctagattaagtagttaacatgtacatctttctacccaggatgaactttttgcttatttattttacagtttgtaaagatgtctcttttttgagatacagtagccaaattccacatcacatttagtttgtagaaccgtcacaaattctgtaagagcaagaaaatgctctgtatctaaaacctcattttaaagaatcagtcc

SEQ ID NO: 259089 - DNA, 563 bp, Homo sapiens
gaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaa

SEQ ID NO: 259090 - DNA, 451 bp, Homo sapiens
caagaaatctagtgaggtttgccacccagatttagcaaataaaaatgcaaagtgcccagtcaaatttgaatttcaggtaaatagagaacaaatttttagtgtatgtcccatgcaatatatgtggaattcaaatttatttgggcatcctgtatttatgtggtaaagataacagggtcaaaatatttcagaacctttacaggattctgaaattgaaacagcatttcaatttttcctgcttccgtctaagaccttttagttttcaccgtcgtcttctaggtcattatgctgaaggctctggtcataggtaagacccaaggagtccatttccaaaatgataatatctgtaattttagttctaatttacataattaaaatttacacttatataaatcctttccacaatagaatatgatgggtggttcctttttgaacataaaaaggtattttatgg

SEQ ID NO: 259091 - DNA, 544 bp, Homo sapiens
attacaaatgtatttgtgcgtgcatgtgcacagacatgtacatgaagagaaggattgtgtgtgtgtgtctgtataatcagttttcagttatcttctgaatgtagggaagccatgtcagatgcagatactgggttgtcagaaaacaagttatctttcgttttcaactgcatggtgtacttttttattttccaagtagatttacatttccaagttgatatttcctaaatactaattagctggaaattgggggagatcatcttgtcatgtactgggtagtaggagggagcctagactttaaacttgattgttgataacttatggaatatgtaggtaagttgctactgaaaaatataggcagcttgataaaacacagtggctcataatcaagtgctggctaatgtcagcatctagaacagcttcttacctatgacagatgttgaactgatgttgagtttaatgtccgtagttaaagtcaagcagttagcaaataaataaaagcaatcagcctttattctcaaagtttggtttagatacaggcttcttt

SEQ ID NO: 259092 - DNA, 945 bp, Homo sapiens
tcaaaaaaaaaaaaaaggtaataatgtgaggtgatggatatgctaattagcttgattatgataatcatttcacaatgtattcatatatcaaaacatcatgtgtacaacttaagtatatacaatttttatttgtcaattatatctcaacaaagctggaaataaaagaggaagcttctttaaagatgtgtctatgatttcccagtgacatggatcatttaggattgtaatcaaccattgaaactgttagttagccaactaaatctcttatatacaaatagaaaccttgaatctcataaaatcaatacttaatgaatacctactgcatgctgagttccagagacacatgaataaaggcgatgtaggctgtgaccttattatactgggctggattctgtggggtgggactgagtagaggggatgactcgctttatctgggggcatcggggaaggctttctaggggaccagtctggatcttggaaaaagcagagagctactttatgctttaatctgcattaaaattgtccagtggtaaagcttgatatgctgtgtggatggtaaatgtttcttacttaatcagaaaagcatcctaagagtgatggattctaaattgatttttactgcagtggatgcatacaaaatgaatgaagggaattagtctatagttcccccacgcccctaccctaagagatagtttgtgtgaaagattatacatgagtgaggaaacaacagggccaaacctgaaggatgaaaactgattgacggacttgagttgaaaataaaaacaagcaggacgaggctgcgattgcaatgtgaagtcagcatgcatctactgtaatttattcaaatccaaccactctccaagctgtaaattatatataacctagaaaatcacacctataattattctgaaaattggtgaataaaagtataagcctagtgaatcc

SEQ ID NO: 259093 - DNA, 290 bp, Homo sapiens
  misc_feature (2)..(2): n is a, c, g, or t
gngcccaggagtttgagaccagcttgggcaacataataagaccctcatgtcttaaaaaaataaaaaaaataaaaactaaaaactttgtgtattatatatgctcagtaaatgatagttctcttatctttcccactattattggttttaaagaatggtgtagacaggttttccttaaatggcctctgttgttctcctttctcccaaaatattcattattaattttgtctaattttcattaagaaatttgtaggtattggagtaaacctttgttcacttcttttttttttttt

SEQ ID NO: 259094 - DNA, 744 bp, Homo sapiens
acttgggctctcgaaatgtgactgtgggtggcatgaagggatggaacttggagcttgattcacttcgctgccgctctggccagcaccgctcaccgtcagttccatccgaggctggctgtccaggctgttcatgacgcaggccctgttgcacggtttccttatagagtccagagtcagctcactcctccattacgtcgcacatccacaaaggaggggaaggagaggcagcggcatcgctgcccgccgcacggacggatcaccagcagctccgatgaaggcggaggttttaaactacagttgtgtctaagatgaagtttggggattaggtgtctctgctttccattaccccagacagaagtgtgctggcagaatgtctgccctcggagccagctggctggccaaaggtgaaaggagaggaggagaaaaagaggcgtctatcaatccactttttccatcagcacggtcctctaaggtagactgctggcctctctgtcacgcccccggaaactgaagctctgggatgtgtcggagttacccaaggacacagaaagccttgtccccaagggcctgtcctagattgtgagactgttggtatatctgctctcagcgctaacaataaaaaatagaaaagaaaagcccacagtgtaagtcttaaatttgagggaaatgctgtattggcttaggactgagaaatagatgtttgacatctagatagaaatatcccaaataaaagttgtcaccttg

SEQ ID NO: 259095 - DNA, 283 bp, Homo sapiens
atatatctctctatatatttcacttttaatattcagggggaagaaatcgtcataagtgaaaggttattttccatgaaaatgtggcccacaactcgtgttgccatgcagaaccttctgcttactcaatattgagtgctggaaaatgacagaatggcctctgtggacctgaaaattggaatgatcttcctatttgtgggcagcaagccacccagctgccgaggcaagagaccgagggcacgagctgttccagcataataaaatatataaaacaacaagagttata

SEQ ID NO: 259096 - DNA, 675 bp, Homo sapiens
gggagagagagctggaaaaagagaatttctaactcaaaatctctgaacatgtgtaggcctttctttggctttagctttgacttccatccatcaattattattttttgaagtttgaagccctgcatgatgtaactaaccagaaacttctcccttatgacccttccagcatctgagacccactttccaaccattccttctgccctgcctcctttacaataactcctgtttttgaattcatccctatgtaagtgggagcaaagctggatctagcaaggaaacttgccaatagatcagaccaaggtaggagagaggtttggttcccagccatgtgcctttgggtggtcttattaatagtcaggtttggtactgattactgcctagggtttccctggcactgaaagttggcagaactctgccttatctggctagcagaatgtctcccaccctaagcaatttcctctctgaggtggaaaccaggggttgcactccctgacatgttaataaactaacatgataattaggtgacaggtcacaggttccatgacacataaagaagacaacaccactctcaggcaaataacatgctgtgggaattaaaatgttttccttctcatggttgacaatctaggacatattcattagcaatgatacaggggaaaagacaaatgcaaaatg

SEQ ID NO: 259097 - DNA, 410 bp, Homo sapiens
gttaaggggagacaacaatgactgcacggggtcttctttcttggcaaaaaacctgttatctggcatgaaagaagcaatttcaatatgctggttgatgattctacaatggggacatgtacttagttacagaggtgggctttatccaatagattcccagagtccttgatactggtttttcgatggacacacatttgttcaagaagttttggacctctcaggattgcactggaaatcttcaattatctcccttgaaatcagagtggcaatgtgaagatcagttaagtaggaaacgcttttgtacaaaaagcaaataacaatttaatcattcttaattttctgtgtatggtactgactttgacataatgaaaatcaaggtaagttttaccattgttctcatttttaattgtagc

SEQ ID NO: 259098 - DNA, 727 bp, Homo sapiens
cttcttgcctcacctaataatagtcacgagatcaagatgaaactaccagaactcagttgatctaaaaatagatagagtctcgtcaggccagctgttaagaaaatgagagtaaaggaatgctcagccagaactgaataattaaactctgcaatgatcatgaaatgtagaggactaagtcactggtctgagtggcaggcagttggacccgagcagggagacagggagtaaaactgaaagtgctatcaatatcaagaagagtcactcagaagcatagtattcaagttgacaggcaaaactttaaattttaaatagagtttctaggttggatacatgcaggaagtcagaaattcacataagctgttgtagaaggagagatagattcacatacaatggcagccatttttaggccttttactagaagctagaaaatgagaggggagattacaaacgagaaatcctaaaagaatgtagtaggggaacttgtagccaaacacctaaaacatctgatacaataattattacataattaaattatctaggaatttgtataatagggtgttggaagaaaggatataagacaagaatatataattttatttaatataataccctaaatcctggtcaaataaagcaagtgaaagtaaaataaaatgaatttactacaaagtatttagttcctaagcaaaatatttaaaaacacatttttccgtctacaattaccatctag

SEQ ID NO: 259099 - DNA, 379 bp, Homo sapiens
aagatgttgcccaggagggagtgcaatggtgcaatctcggctcactgcaacctccacctcctgggttcaagcgattctcctgcctcagcctcccgagtagctgggattccaggcatgtgccaccatgcttggctaattttgtattttcagtagagatgaggtttctccttgttggtcaggctgttctaactccggacctcaggtgatccgcccgccttggcttcccaaagtgctgggattacaggcgtgagccaccatgcctggcaaaatccaatttctttaaccaatatatggctacttagattatctatttcttcttgagtgagctttggtattttgtgtctttcaagagatgcgttcattttatctaattctcgtg

SEQ ID NO: 259100 - DNA, 694 bp, Homo sapiens
gaatatttaatgtaataagcattttacaagcattacctcccattattatttcaatcctctgaaataggaactctcattagttctgttttgtaaacaggaaggcctagcctcacagagttaagtaatttttccacagcggtattgctcgtcagaggtgaacagaacctgaactccagttttggaacatttagagaaaaataaaaaggagagtcaatatatttcttttttgtgggtttctttttaaaaagtgcaacttacttttgatctggaataatcatattgcattaaagtattttctcttcaagtctcaattaactacacccagtcaattataatcattgaaatatttagatgctgagttttaataatacaattcatggggtcatttatgacaatttatcatattcacttagcaatgacacaatttcacgggtgaaatcatgataccaggattggacaaaataaataaataaaaagatctggccatattttcactgctttgtgtttcctcctttgaaattggtccccagcaataaagtattaagggccgatagacactggcaagaatgctcaaactcactaacattaaaataaatgtaattaaactttgatttaaaaaatgatgattcatattagtaaaaaattgaaaaagtcttaatgttgatatgttgggaataatatgtttggagggaaa

SEQ ID NO: 259101 - DNA, 448 bp, Homo sapiens
atgaatcattgcaggacagtatttcctggcatcgagctctgtgcaccagagaccacgctgcaagcagataggagctgattgaccttaagtgactctcaatctaataaagacaaggccagaaattttggtctagcaacactaaagccagtgatttggaatttcagctcacagatcctggatcttctgctttgaagaaagtttgggctttggcagaatcgggtgctattagcccaaagaatgaagctcatgacttaagagtttccatcacgactcttgtcaggggaagcattctttcccaggcacacctctctttgtctctgggtttcaggagcaaaagttctgcaagagtctctaaggtgagtcagtgcctgtgagccctggttgctcttccaatttaagacctcagggttgaaataaagccagactatggagcaaaccctaatccctt

SEQ ID NO: 259102 - DNA, 658 bp, Homo sapiens
cccagacaaatctcattttgtatctcccagaattcccacatgttgtgggagggtcccagtggaagagaattgaatcatgggggtgggtctttcctgtgctgttcttgtgatagtggagaagtctcacgagatccgatggttttaaaaactaagtttccttgtacaagctctctcttctcttgtctggcactatgtaagatgtgcctttcaccttctgccatgattgtgaggttttcccagccatgtggaactgtaagtccaataaacctatttcttttgtaaattgcccagtcttgggtatgtctctttttcaccagtgtgaaaatgactaatacagtttccatctgacggtactaatacagtttccatctgctgttgtcatagtgtagcaaagacaaagtcagaagacctggatttgatccaggatccaccactgaatagcttggttaccttggtaagtccacttaactaagccttaatttcctcatccacaacatgagaaaaataagtcttcatgatttttttttgtgtgacatcaaacacaatgtatgtagtatatactatggaagatatagtaggtactcaattaatcactaaatattattactattattactttcaccattattaactacttttccactattcaaggtatttt

SEQ ID NO: 259103 - DNA, 492 bp, Homo sapiens
catcagaatcatctggaagaattgttaaaagagaattgctggtccccaaccccagagcctgtgattgaataaagctggggttgaggtcttagcatctgcatttctaacaactcccagcacctgaggctgcagatctggggctcacactagaagactcacttctctaaaccacttgttcccccgtcttatttccctgacttagcctccttgtctccactcccatcttacttcattctactccagccacactggcctccttgctgtgttgagcctccctgggcacatgccttaggctactgctttgtctgcactcggattcgtaacacttactccctcacccctcagtgagacctaccccaatctccctacccttttcagaatttattctccacaacacgtaatcaaccttctgacatgctgaataatttacttattacatttattgttttgctctctctctgctaataaaggaatgacacccttaagacatca

SEQ ID NO: 259104 - DNA, 419 bp, Homo sapiens
gatacattgggcagtagggaggtctgaagtggccgtgtgcaaaccaatcatggaaagacggactagtggacaggacacacacgtgaaggataaagaggccacaacggggtgaagttttttgataaggagcgggttgggccaggtgcggtggctcacgtatgtaaccccagcactttgggaggccaaggcaggtggatcacctgaggtcaggagttcgagaccagcctgatcaacatggagaaaccccatttctaataaaaatacaaaattagctgggtgtggtggtgcatgcatgtaatcccagctactcgggaggctgaggcaggagaatcacttgaactcgggaggcggaggttgcagtgagccgagctcgcaccattgcactctagcctgggcaacaagaccgaaactctgtctca

SEQ ID NO: 259105 - DNA, 702 bp, Homo sapiens
gtgattctaataggccaatcaatcatccacaagagtaagaacttcacactggcagaggcaaagtctggatgacctgttccatgaggtcacctccccttgccttctcccatgcattgtcatggagctccaataacagcttcatgctccatccacctcagtccacacagaggtctctaacagtcaaatgttagttttctttgaagaaccttaaaaaatggctatttgcacaagcttcttaaagtctgacaaaatcaaataattgaaatagtagagaataaagtgagtggattcaaaaaatccacatgccccaaaaaagaaattccatgagtgaataatctgagaaaatgaaaaccagaactaaacaagtaaacatgttcttcttccttgtatccaaaatttaagtagattgtcactttcttccagaaggcacttcacatagtagcctttggtaactgctgactttacagagagatttattggaggtaggaaagctgtaatcactgccttgccaaagcagtaaacataagggatttactttccataacaatttacttgtatatttttaaaaatacttcaagaagaatgtgcattcgaagaatatttcatggaaatgagtataagatgctaattataagtttgggaacttaaaagataccacatatttaacacaaaattactgtcaaaaattgtcctacatggtgg

SEQ ID NO: 259106 - DNA, 321 bp, Homo sapiens
cacaagctggagaagtagtctaccacattgctgcagttgctgtcgtgtataatcggcagcagcactcccagaggctgtacctggggcacgatgacgacattctcagcctgaccatccatccagtgaaggactatgtggctactgggcaggttggaagagatgctgctattcatgtgtgggacacacaaactctaaaatgtttgtcgctgttgaaaggacaacatcagagaggagtgtgtgcacttgatttttcagccgatggaaaatgtctggtgtcggttggtttagacgattttcacagtattgtattttgggactgga

SEQ ID NO: 259107 - DNA, 783 bp, Homo sapiens
tgaatgacatctggcaaaatcccaggaggcacctccaacctcctgtgactttacaaaaggcctagtctaggttcctgattgccttacaactttcctgtgaatctgatgaggaggaagcgtgaaatacacttggctagaatggagaccgtgagtcccaagtcaggcctccagtcactgcccttccatcttatgccacacaccttccgaggggcgaaggaaaacatgagtagaattagtatattttggtctcacagatatttgtgagcatcacgaagccattcccctaattgctcttggttgagagattacaacagcccttgctgcaaaactcccccacaacctaacctttcagagtccaatcttgcaaagctaactcagggagagctttgcttaaattactgggctagtattatgtgagtgtgaagttgccaaggaaaatgagtcagacactaatccctttgctaggagatgagagaaaaaaaaaaaaaggctggcagacctttactattttaattacctgcttccagaacaataaaagagaattcagatcttccacttaacagtcgtgcccttcttatattcccgtaaagtacctgcactatttccttaagatgtaagccttgggcttttttcctttcaactgtgttcaagctatagttccgaccattcgattttggacaaaaataagaattaaaatttcctttgctggttttagttacaaatattggaaccaatgaacatttaaaccttgtttctttcttgaaagatttttcagagttttaa

SEQ ID NO: 259108 - DNA, 579 bp, Homo sapiens
tgattagcggtaagatctcactatgttgcccaggctggtcttgaactcctggaaagtgatccttccctcttggcctcccagagtattgggattacaggggtgagccactgtcccaccacagttttttttttcttatggccagctcttatacagaaataacagatacaccccattcttcttaagactcaccacagcgccccttgctgcctctagacccataaatacctagggtgaaatcagcttgctccaggtgaacaggtgccagctaggacctaggcgggagcagcttttacactataagaatgacaaggcttcgcaaatatacagagtcagaaacttggggaatgtgtgcagaaggggattttaaggatgttacaccaatgagggtggatgtaacactagctcaggccaaatttactggcatgagtgcgctttctagagcttctggatttcatgggttaccttgtgcagctggacgtagttctaatagcttgcttgggtgcctaaccggaacttggatccaacagtggcctaaagttaatgaggcagagagaccagaactgccctagcataagatgg

SEQ ID NO: 259109 - DNA, 686 bp, Homo sapiens
ctgtgaacattcatgtgcaagtattttgtgaacttaagttttcaattctcttggctatattcctgggagtggaattgctaggtcatatggtaactttcccattttgagggactgccaagctgcttgccaaagcagctgcgccattttacattaccaccagcaacatgtggaggttccaatttctgtacgtctttgctaacacttgttattgtctatcctttttaattatagccatcatagtgcatatgaagtggtatctcattgtagttttgatttgcatttctctgatgactaataatagtgagcatcttttcatgtgcttattagccgtttgtatcaaatcctttgctcatttttaaattgaatttttaaaattattggtttgtggcagggcatggtggctcatgcctgtaatcccagcactttgggaggccaaggcgggtcggtcacctgaggccaggagttcgagaccagcctggccagcatggtgaaaccctgtctctactaaaaatacaaaaaatagtcagacatggtcacaggcatctgtagtcccagctacttgggaggttcaagccggagaatcgcttgaacccaggaggtggaggttgcagtgagcctagatcatgccactgcactccagcctgggcaacagagtgagactcaatctcaaaaaaaaaaaaattatt

SEQ ID NO: 259110 - DNA, 615 bp, Homo sapiens
tcaaccttttgccccttatttagcccccaccctctaattccccccacctaaagggagaggctggatacccctacgagtgccccggtcccgaaattccccgactacctactaataaaattagcgcccggtcgacggtaattgccatccttttaaattaaacccatcatagtgcatatgaagtggtatctcattgtagttttgatttgcatttctctgatgactaataatagtgagcatcttttcatgtgcttattagccgtttgtatcaaatcctttgctcatttttaaattgaatttttaaaattattggtttgtggcagggcatggtggctcatgcctgtaatcccagcactttgggaggccaaggcgggtcggtcacctgaggccaggagttcgagaccagcctggccagcatggtgaaaccctgtctctactaaaaatacaaaaaatagtcagacatggtcacaggcatctgtagtcccagctacttgggaggttcaagccggagaatcgcttgaacccaggaggtggaggttgcagtgagcctagatcatgccactgcactccagcctgggcaacagagtgagactcaatctcaaaaaaaaaaaaattatt

SEQ ID NO: 259111 - DNA, 810 bp, Homo sapiens
ccctggctacacttaccaccgaggagggagtggtgtgtgatgcaggagtaacaaaggcgttgaaggcaccacgtgtgtaacaggcacgcgggagtctgggttagtcagaaaggggaaagcagtgctcaggttgactggaaacataggccggtgaccggagacagcctgaggctccagaacacacaagtgacctgtgaggaaggaaactgagagaccctggagagacaccggtggtgccctctcaggtcctcttgagtgttacgaggacggggaagaaatagagcctcccagccagggtcagccagcacagcctctgtatgtgaagcgtcaggacagcgacggccgggaggaggggatgctaggaagtgagtaccagaagcactagacagggttttgggaagctatatttagctggggacgaagaaggaacaaggaaggaacaggcagatggcatagcacgaacgccgggtggaaagtggaactgctcgctcctgtcgtgtgtgtctcttctccatcaaaaaagaggctcttaaaaatcgaaagcatgccacagatacgatcagaggctctttggaagctgcatttttgtaactggttctcgatgatcctctcccatggtaaagatttggcaccatatgaagtccttgggaggacaaatcttcaacagtagcccatagatgaaacccagatagctgtggaaactaatgtgctctttgaatgttaagtcaggaaagcttgagtggcctggcacgtgagccgagatcgcgccactgcactccagcctgggcgacagagcgagactctgtctca

SEQ ID NO: 259112 - DNA, 692 bp, Homo sapiens
ccctggctacacttaccaccgaggagggagtggtgtgtgatgcaggagtaacaaaggcgttgaaggcaccacgtgtgtaacaggcacgcgggagtctgggttagtcagaaaggggaaagcagtgctcaggttgactggaaacataggccggtgaccggagacagcctgaggctccagaacacacaagtgacctgtgaggaaggaaactgagagaccctggagagacaccggtggtgccctctcaggtcctcttgagtgttacgaggacggggaagaaatagagcctcccagccagggtcagccagcacagcctctgtatgtgaagcgtcaggacagcgacggccgggaggaggggatgctaggaagtgagtaccagaagcactagacagggttttgggaagctatatttagctggggacgaagaaggaacaaggaaggaacaggcagatggcatagcacgaacgccgggtggaaagtggaactgctcgctcctgtcgtgtgtgtctcttctccatcaaaaaagaggctcttaaaaatcgaaagcatgccaccaataaaccaagtgtgatcagggtaaggtacaggaaagaaagaaatatggggaaatgaagtgaatgatcgggtggatcagatgagatacagtcatggggtcaggtgtgtatctggaataatgtggagtccgataaatccag

SEQ ID NO: 259113 - DNA, 435 bp, Homo sapiens
gggctgcaggtaaaataatcactccacgttagtgtctagtagtattagcaagggttggcaaactattcaggagataattgactctacagtttattctgtcccaacaaatgtaggtacacaacaaatgtgtgacagtttattctgtcgtaacaatgtaggtatgcattgaaggtgtaggcttggttgtggcgggagtgagggatctctgtgcatttcctggttccttgaaaataacttgaagtcattaagacaatataagaggtacaacagagagaaaagtgtatttcctttttgatgcagggctatgcatcttagagctctttgtaccctgtgcttttgttccactttccccttctgtccaaaatgctctcagctcatttcccctcttagccaagattgcttggctagagcaaataaaagggaaatcaggaaaaa

SEQ ID NO: 259114 - DNA, 464 bp, Homo sapiens
gtcttattactaaataagcaccttttatatataaaataaatgaatcaggtattgttaacaactggacttagaagttgatttcaaaggtaaataaagtatcaaaggctgattttcttttagaacatcagaataatctacataaatgagtttcatctgcttcaaggcatgagctaccttgagaataccagatatatactttaaaaatgctacctgtagttaaagcatttctagagctttaaaaaacaatacccatgtatttctttaccattaaaggggactgattttggagtcagcagtcccttgggtctacgtctcagaataagacaggtgatgcagttgaaacagcatgcgattgtacggtgccactgcagtgcagcccagtacaatcaacacacagaatggctccctaatcatcctgactgggagggtaaatttgtgtaattaaataaattctataatcctac

SEQ ID NO: 259115 - DNA, 746 bp, Homo sapiens
gaactagtggatcccccggctgaggttttcgcacgaggccaagttcacttagaatgttttcacttgtcatttaacaaacattagacaaagatctactgtgtcaagaacagagatagataataactaaaaagaatgagtctacttagcattaaagataaaaagacaagtaagttatagtcccaatctgtcaggatctcagagtccaataagaaaggcaaacatgtatatacataattataatcaagggctatttgggcagtgagggagtgtgtacaaggtagagggcactgcaagaaaggggataattaactctggtagtggagggaatacgtttctgcaggagtaacaatgtgtgaatagattttaaaagatgagtagaaatttgttaggttttcaatgcagaaaagcactcctggaagcaaacagggagctgtgaaacagcatggcatgttaaggaaaattgcaagtagtgaggtatagatggaaaataaatatgagaggtacaggttacaacaatacggatgggaatgaggggttaatgcttactgatatggtttggctatgtccccacccagatctcatcttgagttggtatctcccacaattcccattgttgtgggagggacctggtgggagatagttgaatcaaggaggtgggtttccccatactgttcttgtggtagtgaatgggtctcacggtctgatagttttatggggagaaaccccttttgcttggctctcactct

SEQ ID NO: 259116 - DNA, 705 bp, Homo sapiens
gaactagtggatcccccggctgaggttttcgcacgaggccaagttcacttagaatgttttcacttgtcatttaacaaacattagacaaagatctactgtgtcaagaacagagatagataataactaaaaagaatgagtctacttagcattaaagataaaaagacaagtaagttatagtcccaatctgtcaggatctcagagtccaataagaaaggcaaacatgtatatacataattataatcaagggctatttgggcagtgagggagtgtgtacaaggtagagggcactgcaagaaaggggataattaactctggtagtggagggaatacgtttctgcaggagtaacaatgtgtgaatagattttaaaagatgagtagaaatttgttaggttttcaatgcagaaaagcactcctggaagcaaacagggagctgtgaaacagcatggcatgttaaggaaaattgcaagtagtgaggtatagatggaaaataaatatgagaggtacaggttacaacaatacggatgggaatgaggggttaatgcttactgatatggtttggctatgtccccacccagatctcatcttgagttggtatctcccacaattcccattgttgtgggagggacctggtgggaccctcaatccacggggtggtcttccctcaaccggcctctccggacggcgtcccgcctcactcgcgcgcgt

SEQ ID NO: 259117 - DNA, 435 bp, Homo sapiens
tgagaggaaaggcagtggggaaagcaagagtgctaatattcttgtccaaaatcgtcatagatttcagagtcactgtgtatgatggttgaaaccagttacagatgataaattagagaaatatttatgcattgttacagggatacaaaatagcaaaaattaagtttcaaagacggacagggggagaagaaggcagaaatagctctggcagaccatcctggactgcacttacctttccatggcaaataaactggacatctttacagatagaagtggcatagttactcctctcccccgactgtcctttgatgggtaaatattaaacaaaatatagcacaaccgtaggctaggatactgctcagtgataaaaagtaatttactactgatacagaccactacctggatgagtccctaaagaattatgccatgtgaaaaaaa

SEQ ID NO: 259118 - DNA, 294 bp, Homo sapiens
ttttagtactccatagcctatccctttcatttagctgggtagtgtggtcaattttccccataacatgcgttctcacataattgcatgtatttctggggtacagtgtgatggttccatacatatacacattgtgcaaccatctaatcagggtaattagcacatccatcaccaaaacacttgtcatttctttgtggtgagaatattcaaaatcctctcttctagctattttgaagttaacattatcgttgagtatagtcatccaaacgtgcaagagaataccaaaacttattcctt

SEQ ID NO: 259119 - DNA, 440 bp, Homo sapiens
tgttttatatacccactttctttactcattgatattacctgcctagtggctataggcattttagtatgtacccacacatgtaacacttgctgatttcttggggtggtagtaggttgtgtcatggatggtaatgactttttcatatgctggaactcttgagccctctggatttgatacccatatcaggtgatgagcttcacttggctcccttggcaccggctaggatctagcctaatcccacgtaattcagtcatctgagacataattagggcaaggtggattaaacactgttcaaaacctgccggataggagatatacatattaaatttatctttcagatgcaacatattagaaattgtactctggatgctgcctgtcagatggcacagtctgcaaaaaagtattgtataagctgcttgaaaaaatgtaatatggtatgc

SEQ ID NO: 259120 - DNA, 472 bp, Homo sapiens
gtgtcagaaaagaagatgcatctacaaaatagtaaaatcatactgtgaacccttacacaaggcttggactaaggaaataaaacacggggagtcatagaagacccagataatcatttaagctcttctgcttagagagctgttccttaagatttctgaaacttcaaacttgatcgtatggaattatcttgcaatcacggggatgaaaacatgttctgttttctcatttcaatgctttggtcatatgtggttttattcagtaactttgctcacattactcttatcttctttggcacattatgagaaattttcagaaaaaaggacacctggaatatgaaaggcagcaaataagaattattctcatatctaaactgatgaaaataatgcatttgcacgtcatgtccttgattaattccaatattaatatcatatatagtccttggaagccaaccaataaacactgttccaaataata

SEQ ID NO: 259121 - DNA, 453 bp, Homo sapiens
aatattttaaaaggctttttataaaaggcaaataaaaagcttaagtgactgattgataagaaaaattgaatctgctgaccttttagttttgtcatcatcctgccctaatagcagaaagaaagctagcctaaagcgtttataaaaggaaaggcttctttttcagatctctccctgctgagtccaggcataaaggatgctttctctgccctattccttaatggagtccactgtgaacccagtaattttagccaagaaacagtagctaagttaaacggaacacctatttaactaaaatacacctttctggaatatgattggctaacctgaaacccttttgtaaaagaaatgtacacctattaaggaatctccatttttaaggatgtctgcctatgtacattggaaattttaccactgttttaaatttacataataaatcgtacttttgtctaaggt

SEQ ID NO: 259122 - DNA, 331 bp, Homo sapiens
aattggagaccatgcaactaccacaacttttagtcatcgtacggattagcctgatgagtatatccacaggaaaaaatgtgtagttctggtaaaatattttttttcagaatcagataaaaggaaaacaataaaatgtggatatccttgttttaaaaaatcaacaatatcattatattgagatctatctatctggatcaaagaaggtattttttggctgtggcagattgcatttttccagtagtggctgcaataatatttcccatcctgcaagttttttgagaaccttgacaaattctcatcaactgactgagtttatattctctcctcttga

SEQ ID NO: 259123 - DNA, 335 bp, Homo sapiens
attaatgtagtataaagaaataggtagattaagccagagtttttgttattggtttttatatttattatatatttatttattttttgagacagggtcttgctctgttgtccaggctggggcacagcagcacagtcacagctcatagtgacctcgatctcctggtctcaaggcaatcctcccacctcagcctcctcagtagctgagactacaggcccatgccaccatgcccagcccgtaccctgtatttcttgaagtgaagaatataaagtctgtatgggtgcagttcctgagtgttctgctcttccctaaagtttatatatttttttagcttaagt

SEQ ID NO: 259124 - DNA, 634 bp, Homo sapiens
acataacagtagaaaaccaaaatttgttgtcatctcttcaaagaatcgagaattgcgtacaaaaaaaaccttacataaattaagaatgaatacatttacaggcgtaatgcaaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccctgcacagatcagaggctgctggccacacagactcaccaagccacagacttgtcttccacaagcacgttcttgtgagcagggctgatggaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccaga

SEQ ID NO: 259125 - DNA, 571 bp, Homo sapiens
tgaagtaggagagacatttaattcaaaaattgcaatgaaattgtggtaagttctctgaatgtaggatgtacaaattactttgggcacctggtaaagaaacagaccaacatggcttggctgggtcagagcaacttcactaagatgttatttgaactttctttcataaagataaatagaaattcctgagatgaacagtgcagaatgaagtattcccagcagagtacagagcttccagttctgtgtgtcattaaaaatgagaagaaaattgttgacagtagcagtcttgggattatagggggagacaggagttgtggaattacaggagaggttcactttttacctgatatatttgtataatgttagatttttgtgtaataagtatgtgttacttcagtaatcaagaaaaagctatcaaatactcctctacccctactcccaaaaaagaaattaaaaagaaaagaaagagttttggtattgtcattatcataaacaccctgttaacagaaacaacacagcagaggtaaggagttggaagagttgtccaggagtcaccaagcctccctggcccaga

SEQ ID NO: 259126 - DNA, 528 bp, Homo sapiens
ggaagctcctttttttgtcattcatgtagacttaacattcacatggcctttcaccttacggtggcctccaatagctccaggatgagctttacagctccaaatatagtgaaaggagaatttcttttctccaacaattctaatgaaaattctggcctaattctcactggcccaagttcagtcatgtgcccattcctgagccaatcactgtggtgaggaaaacagatgcataaccaaccttatcctcaggaatcctggaactgggtgaggggaaagagggacagtcagcttcatctaaactatggactgagagttgaggcaagatgattcctgaaagaaaattctaagtcttgctgctataagtggaagagaatggtgggcaagcaaaagcaaccagtgcccacaccaaaggtaaatctaaaacaacatcccatttcagtacagcaagcggttctccttcacacagaggaagctcatctccaagtttttatttggccaggacatgaaccaaataaacaccttccaaagaaa

SEQ ID NO: 259127 - DNA, 425 bp, Homo sapiens
ccccagccatgcagaactgtgagtcaattaaacctctttccttgactggtctcgggtatttctttatagcagtgtgagaacagactgacacaggcaccattgtcatcatggcacaaaagaggacgcatacgcacggagatgttaattaaccagcccaaagtgccacagctcgggagtggcagagccaggctcaagcccagcagtgcggccaagtctgtggccctgcgtgttgcctgttcctccttctgagccaggaaatagtgaggggctgagcctgctccctctgctcgggtaagttgctgcccctcagcctcactctcctcacaggcagtcaggtaagcagcctattcgcagctggggatgtgaggtcaggtgcagccaacatggagacctggtccaggtgaggcgcttctgagctggagcca

SEQ ID NO: 259128 - DNA, 704 bp, Homo sapiens
attacaacagcatgtttgatgagtaatagtcacattttatagattaggaaaattaggtcataaagggttcagtccattggttcattcaccatatattttattctggatcatgtactctactagatattgagcagtcaaatagcaataataacaatagctaacattttattgagaacttactgtgtgccaaacactgttccaagcatttgacattcattgtcttgtttattccactgaacaaccttgtgaaggtggttatcatcatccctattttatgcatgaggaaattaaggcacagaaccatttagaaatgtgcttaagggcaggtggctgggaagtggtgaagacagagtggcttcaggggccaggactctgacatgataccatgctgccaagcttctctctggaagttcagggtagcttgcctcaggtcacacaacagcagtccaggctggttcacctgacccaaagcaagctctttcctcagcatcataatgcaattgcacatagtgaagttggagttctattttgaagaggattgggagccaacaaaaggttttgggaggaaaatgatgtgttcccatcaaaattatgcccatatttcaaagaagggatgggtccttcattggatttattctgactacgagacaaacacatccccataaacacttcccagaggccacacattagtgtggtttatactg

SEQ ID NO: 259129 - DNA, 319 bp, Homo sapiens
attttgagttttgatggcactcctatacgtagggttcactagggcctcatgctttccctacagaccttacgaagttctctccttttccacttctctgtccaggaagtttgcttgtttggtttttgtggggttttttccccctagtggaaagaagaagaggaaaccctggttcccatattatttgtgttctctcaaatctactgtgttgcccacgatgcacaagactgttgccctctttattttgtatatcattctaagagcctcttctttgaaaacatgaaagttaaggggaaaaacatcatttccctctggctctggc

SEQ ID NO: 259130 - DNA, 283 bp, Homo sapiens
tttttctgcacacaccaagcaagaaatcagttccgcagcagacaccagctggaagtcctccgattcaattcggctaccatctacctggagatagcgtcagatcccacagggctcagttccataaagctgccttctcttcagacaccagcgctaagaagattgaaatcccgagaaacaattttctgaagaaatgaaatcatatgccctcctgaactctttgggggaaaatagcctctctgtttgctcagaatatgaaacagtaaaacagtacaagtaaaacagt

SEQ ID NO: 259131 - DNA, 412 bp, Homo sapiens
agaattttcttggaccacatataaaatacattaacacgaagtataatttatgagctaaaaacaaacaaacaaacaaaaaaaaccacaaaaaatcacaaacaaatctcataatattttaagaaagtttatgaatttgtgtggggccacatgcaaagccgtcaaggccacattcaaagccatcatgggctacagggtaatacacccttggtctactacatacagcctggttcaagtatggatactcactcaagctatgtactttttttttttttttacaggattttgtttgttttatctgtctttgtttctttgtttatttttccattattatacatatgtaactaacctgcacaatgtgcacatgtaccctaaaacttaaagtataataaaaacaaataaataaataaaatta

SEQ ID NO: 259132 - DNA, 472 bp, Homo sapiens
gtttgatggtgttctgtaagtctcttaaactatcctcactctttttcattccttctttttgtttctcagattgtatgctttttttttttcttttcctttgagacagagtctctctctgttgcccaggctggagtgcaatggcgtgatctcagctcactgcaacctctgccacccgggttcaagtgatactcctgcctcagcctccccaggagctgggattacaggctaaattttgtatttttagtagagacggggtttcatcattcaagactggccaggttggtcttgaactcctgacctcgtgatctacccacctcggcctcccaaagtgctgggcctgtatgctttttgttgacctgtctttgagtttactgataatttcttcggcctgatctagtctaattttaaccaccccaattgatattttcagctcacttaaagtattatttatctctatgacttctactttgtg

SEQ ID NO: 259133 - DNA, 291 bp, Homo sapiens
cgggactgttgttaaggcagtgtatcatagtttaattggaagtgtttttttcttttttagagatttataaaagtatggtgctgcttacaacttccatgaaaagaatcattggcatataggtagtagttgaagacatgggaatggaggaaacatctaggggaacaaagaatgaagtgaggtctctgtgaataggatctggtatagattctggtgtgtgtgtattttccatttagcagtagaggcagaatgcatacctgctctgactgctaaatgcatgcatttcttgatctc

SEQ ID NO: 259134 - DNA, 445 bp, Homo sapiens
tcgttgtccctggtttctggcacaaagctctaaacccttggaattttgagcaatagagtgttaagagcctcttttgttttagtgaggcaactcttgtacttagcttcagggtgggagctggctgccagaaagaccaagcttgattagaagatcagcatttcctgcaccccctcccccaacctccagggaagggagagtggctggagattgagctgatcaccagtggccacagtcaaacctatggactgaagcctccatagaagcccctaaatgatggggttcagggagcttccaagttggcaaacacatcctcatcccagagggtggtgcaccccatcttgactgagacagtggcttctgcactcgggacttaccttgtcctgggtacttcttcatctggttgttcatttgtactctataataaacggtaagagtaagcacagct

SEQ ID NO: 259135 - DNA, 3386 bp, Homo sapiens
  misc_feature (1204)..(1204): n is a, c, g, or t
aatggtcctctacagatatgaaactggttctggagtgagatgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagcccctcaccagccacttcttccgccaccagtactttgcccctgtggtggggctggaagaggtggaggctgaaggtgcccctggcgtggccccagctcttccagccctggccccactctcatcgccggccaagaccctggagctgctcaaccgtgaacctggcctcagctactctcacctctgtgagcgctacagcgtcaccaaaagcaccttctaccgctggcggcggcagtcccaggagcaccggcagaaggttgctgcccgcttctccgccaagcacttcctgcaggacagcttccaccgggggggcgtcgtgccacttcagcagttcctccagcggttcccggagatctcccgctcaacctactatgnctggaagcatgagctgctgggctctggcacctgcccggccttgccccccagggaggtgctgggcatggaggagctagagaagctgccggaggagcaggtggctgaggaggagctggagtgctccgcactggcggtgtcaagccctggaatggtcttaatgcagcgggccaagttgtacctggagcattgcatctccctgaacacactggtaccctatcgctgcttcaaacgcaggttccctggcatctcacggtccacttattataattggcggcgaaaggccctccggaggaaccccagcttcaagccggcaccagccctctctgctgctgggactccccagctagcatctgttggggaaggggctgtaattccttggaagagtgaggcggaagagggggcagggaatgccacaggtgaggaccctcccgcccccggggagctcctgccactaaggatgcccctgtcccgttggcagaggcgtctgcgcagggctgcccgcaggcaggtgctgagtgggcatctccctttctgccgcttccgcctccgctaccccagcctgtcaccttctgccttttgggtctggaagagtcttgctcggggttggcccagaggcctgtccaaacttcaggtgccggtccccaccttgggcaaaggggggcaggaggctgaggagaagcaggagaaggaggctggcagggatgtgacagctgtgatggccccacctgtgggggcttcttcagaagatgtagagggagggccttccagagagggggccctgcaggagggggccacagcccagggccagccccacagtgggcccttgctgagccaacctgtggtggcagcagcgggtggcagggatggccggatgctggtgatggacatgatcgctaccacgaagttcaaggcccaggccaagctgttcttgcagaagcgcttccagtccaagagctttccctcctacaaggagttcagtgccctctttcccctcactgcccgctccacatactacatgtggaagcgagccctctatgacggcctgaccctggtagatggctgacagggaggtacaaaaggggctgggaagaagggggaccagtttggagagggtcagggacctgagctgaccccaggcttggccaggatgtcctttgctctgggtcccacagtgtctaccctaagtccaagggtatatttgtgttattttctggctccaggacagagaatgccagaaatcagccatctggtctcccgtaggaaactgtgggaccagagatatcctctttcgttgtttgctggtcatatttttactgttatgatttagtttttggttttgatttgagtgggttggttggcccccttgctggagttggaagccgtatgtatgtcagggggtttagaggggggttggttagctagagctgctttcagcttttcctggagacaaaaggagtgttatagcatgatcatcggtcccactgggcagaacgttatcttcagtttcttttgggggttggcatcctctttactcagttgtttcccaaaggaacattaggctcgaatatgggggccaggtgtggtggcttatgcctgtaatcctagcgctttgggaggccaaggcaggaggatcacttgaggctaggagttagagaccaccctgggcaatgtagtgagacctcatctcttagaaaaaaaaaaagaaagaaaatcaaatgtagagctgatcagcagcttgtgcctggcatccccaagggagaaggtgccaggtcagcaggagcagcagcagggatgtatagaaagaaccacagctggcctctaaaggatggcactgaggcaccggagatcttgaggcactggagatcactgaggggctggcctgtcccctgcaaggagtgtgggaccaggtggggcaaggctgggagatgcaggctctgtttgcagattatggcccagagtctctgcttgtgggtgcttgatccacctgctgggaccctgcagtcctcggccagcctggctgtcagttggggattccacctttctgctgagcgtcttctcggagctggaggcccatcttcagtgagagatcacaaagcggccaggcaggtgggagactgaatttgccttgttcgagagtaacgtttgaaaaccaaagaaataaagtgatgcagtgcccacaaaa

SEQ ID NO: 259136 - DNA, 887 bp, Homo sapiens
  misc_feature (865)..(865): n is a, c, g, or t
  misc_feature (870)..(870): n is a, c, g, or t
aatggtcctctacagatatgaaactggttctggagtgagatgagctcggctggggacgctacttgagaaggcctttccccacagggtgacttaaatgtcccaggctggaaggtggagcgagaagtggatgcccccagggctctgggtcacactccaggatgacttctcggaaccagctggtgcagaaggtgctgcaggagctgcaggaagcagtggagtgcgaaggcctggagggtctcataggtgcttccttggaggccaagcaggtcctgtcttccttcactctccccacctgccgggagggaggccctggcctccaggtgctggaagtggactcggtggccctgagcctgtatccagaagatgctccacggaacatgctgccgctggtgtgcaagggggagggcagcctgctgttcgaggcggccagcatgctgctgtggggtgacgcaggcctcagcctggagctgcgggcccgcaccgtggtagagatgctgctgcacagacactactacctccagggcatgatcgactccaaagtgatgctgcaggccgtgcgctactccctatgctctgaggagtcccctgagatgaccagcttgccccccgccacgctggaggccatcttcgatgccgacgtcaaggcctcctgtttccccagcagcttctccaacgtgtggcacttgtatgctctcgcctctgtcctccagcggaacatctactccatctaccccatgcgcaacctcaagatccggccctacttcaaccgtgtcatccggccccgccgctgcgaccacgtgccctccacgctgcacatcatgtgggctggccagccttacagcattttcgcacatcttgcctgggnggctnaaatgactaaggccctg

SEQ ID NO: 259137 - DNA, 653 bp, Homo sapiens
ctcatagaaaattgtcctttaatatttgaatcaatatacatgtatccaaaccatatccttcttcttcatcaactctctagttctggatacctaattagattcatcaattcctccatagccttcctgagagagaggagaattaagcaatgggtcagccagggaactgcctggggtgccaatttaaaagggatgtttaaaaatccctggaataaaacataaatatggtgctgcataccttgggtttctgccagtacttcctaaagtaattggtgaaatgaaaattggccacttctttcacctaaggaggctgggacctttgagtaaaaaattaaaagcaaaagcaagccagtcctcactggtgccaaccactctattttcgtgacaagcgcgtgcaagttaaagggtgtgccaccaacggtgagattagcaagatgggagttgctgaaagtaggcaactctccacaatcacctgatattgagaaacaaaatactgcatgttgcaatgctctttatcaagaatgaagggttcatttccttatctaaattttaaatcctctactataccttccccaaagttacctggtttggagaattgcaaaaggacactgaggacaaaataaaaactacagaaaagtggaaaatggtttgttgta

SEQ ID NO: 259138 - DNA, 351 bp, Homo sapiens
tctgaagctgtgcagtgcttaacctgggccatcatatgcaatgggctgattgtcagcgtgtgattgggaacgttttgctacaaacgtatgattttcatttaggctctacctataaccaaatattatttgaagtggcacagccaaaataataaggatcacagcccagtataaagatgaaaaccaagtagaaagaaaaagggaaggaggaggacaaaaatatatgaagatattgtagataagaaatgttttgaaagcagaacttttgctgaagtgtttccagtgaagatatctgggatttgcttcaaaataattcagtgagaggaggctctcaataaataatcgtgtaacctt

SEQ ID NO: 259139 - DNA, 590 bp, Homo sapiens
gggagcctctttccagaatatttttgaaggcataaaacaaaattcatagggttacaaaggattctcactatctcacttaaaatatacgatatagtaatgtattttttttattaaggcactaagtaacaatctagtgatgggtctaataactactcaaattttgatgtcgtggtgagtataagtacttcagatttctgcagcaactctactgtgattttctgtgatttcttttggtccaaagtgacagatatcaatagtgccactatggtttattgcatttgtcatcttaaaaacatcagacaattggctgggtgtggtggctcatgcctgtaatcccagcactttgggaggccaaagcaggcagatcacttgaggtcaggagtttgtgaccagcctgaccaacatggtgaaaccccgtctctactaaaaatacaaaaaattagtcaggcatggtggcaggtgcctgtaatcccagctactcaagaggctgaggcaggagaactgcttgaacccaggaggcagaggttgcagtgagccgagattatgccactgcactccagcctgggccacaggagtgaaactcaatctcc

SEQ ID NO: 259140 - DNA, 534 bp, Homo sapiens
atgtgtttgagccacttggaaaatatgcctttaagccattcaagaactcaaggagctcagagatcatcctggaagctgtggctcttttgctcaatagttatgttgctatttctttgctccttcagttggctaatctttatttttctccaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctag

SEQ ID NO: 259141 - DNA, 453 bp, Homo sapiens
accaaagttggtctgggcaaagccagtcttaccctgccctgccctgccctgcccggacctgcccaaagtgttttctcctttctcaggagggaatagacttatatcccaggcacaggatagtggctgtatttgcattcccttcccaggaaaagacaggagcatctctcctgcctgccctatggacccgttagcatctcctccatcaagttcccatttggaccctaggagttcaatatcaacagctgaaaggaaggtatcctgaatctcatatgcagtcacagttctggaaagtctggaggtcaggagctacaaagtggatgagggacctgactcttgtcttatccaaatgactttacccatgtcattctctctaaatggatatccctttctcctgggtctcttggtgaactcctagccttctttcaaatctccactcaggcatttcgtctctgg

SEQ ID NO: 259142 - DNA, 206 bp, Homo sapiens
acatttcaaataaaaattccctttgccccagcagttccagtgcttggaatttgtctgatgggtgtcctgcaacatggtaaaagccatacctgtataagaatattgcagcattgtctgtcctagcaacaggttggaaacaatgaaaatgtctaccaggagggactgggtaaataagttgcaactatctccacgacgcgtcattggta

SEQ ID NO: 259143 - DNA, 401 bp, Homo sapiens
  misc_feature (249)..(249): n is a, c, g, or t
aaaataagatagggagtgttagcaaatgagggtttgaaggacagaataacaaagacattggagggagattgccaagttgacaaacatgtatgaaaaagaggtgcttggaaaccacagtcgaggagggaatgaagaatcagcaaagggacagagattcctagtggcaggggtgaagttataaatgcaggtaacgtctaccccacctggaactagtaagatttttttggagtggaagaagctacaatgtcngaagacaaaaaatctcaccagatttataacattcccatgctttgaggaactggggaatgtctaattaggaaaacagaaataccttcaagattttccactgaggaaattaaatgcagagaattgactactcaggtgatggaggtgcagacagc

SEQ ID NO: 259144 - DNA, 376 bp, Homo sapiens
agaaacacattcagcacagtcagacatttgtgtccctctggtcacagtggacacttttaactagtacttgtggctaaacttaagtcatgggactcaggactagaaggggctgtggaaacatccgcgtgtattcaacagacgaaaccagacaatttgagaatcattatccagactgagtcagaaaacactgaagaaaacctcgcactaccaaagggacctccaccctatcacaattacacagtgaggtctgcccccaaagacagatccatgcagaaaagcagcagatgctacagtgggaggattagggccaccagctgtaagccaagtgggtcacaagataagtcttaaaaggcaagtaggaatttatttttcatca

SEQ ID NO: 259145 - DNA, 653 bp, Homo sapiens
ccttgaaaatgaatgtagttttcccttttgtgttaaaacctgtgtgagacagtgacccctttaattccttgcaaattctttcataatggaaatgtctgtcctgtgcttgcctcatcgcagtccctttgtgctgctgtaacagacatctgattattactggcaactctagaaaactaatactcatcctggagggatgcacatagctaagacacttccttcactgaaatcctgagacaggtacaaagtgtcaacagagcttcttcagtgggcacacagaaatgtttgtacgctctgtatcagaataagaaaatgattacgatataaacagaaagatgcaaaagacaacagtagagtgttcctaaaaaccttcatatgatttatcctgggattgtgaaagctgaagataccagaatagtcacttttgttggacccagacaaaatagggccgggaaggaggcacatgcatgcatgtcggaggactgcaataattcaaacaagacattctccaaaggatacctgctcagtaacagcatctccgtcaatgaactgataacaactctggctttgaacctatggaacccatggactctgtttctaagcagcttatgaaaatctttttttgctaataaaagttccccttacacagaaacaca

SEQ ID NO: 259146 - DNA, 745 bp, Homo sapiens
ccttgaaaatgaatgtagttttcccttttgtgttaaaacctgtgtgagacagtgacccctttaattccttgcaaattctttcataatggaaatgtctgtcctgtgcttgcctcatcgcagtccctttgtgctgctgtaacagacatctgattattactggcaactctagaaaactaatactcatcctggagggatgcacatagctaagacacttccttcactgaaatcctgagacaggtacaaagtgtcaacagagcttcttcagtgggcacacagaaatgtttgtacgctctgtatcagaataagaaaatgattacgatataaacagaaagatgcaaaagacaacagtagagtgttcctaaaaaccttcatatgatttatcctgggattgtgaaagctgaagataccagaatagtcacttttgttggacccagacaaaatagggccgggaaggaggcacatgcatgcatgtcggaggtaagaactgcttccaaggacttactaaaaactgcttcacacgcttcatgcttctcctgctctgataaggtttttcattaaacattctttaggactgcaataattcaaacaagacattctccaaaggatacctgctcagtaacagcatctccgtcaatgaactgataacaactctggctttgaacctatggaacccatggactctgtttctaagcagcttatgaaaatctttttttgctaataaaagttccccttacacagaaacaca

SEQ ID NO: 259147 - DNA, 551 bp, Homo sapiens
tacatggacaaactgaatcacagggagggacatgttttcctgtggatgaagatacagataatttttgcatccaagaggagagagaagcatcactctcgatagccttaatattctgttctcaaaataatcaacattatttcaggaatgagagtataagaaataaaattaaggacagtgggaaaatataaatttgtcttggggaatgtgatggggccttctgtattataacagctagaatcttgactgacagttttctgatatagacctttagttctcatgtttgaactccctatattcatttgttcattcttcaatatttattgacaccttaccttgtaagaatcattgtattatgagttgtggatagaaatacaagacataaatcctgccctcaggtagctcacgttttaaagtggaggacaggcacttaaatacagcagtgtggttggagtggataggctcacaggagccgtagcaaaattagcaaatcttgctgagaatgtggggccatgaatgtcagtgaaggagaatagtttttgttttttgttttg

SEQ ID NO: 259148 - DNA, 382 bp, Homo sapiens
ccacatcccaggaggccgaggcggcttgccccgcatctcagaagccgggcaggccctgagccttctgacctcacatcctctgccacaccacagtggagaaaccagaactggaggagcagccagaatgcagagaagaaaaaagaggttctctgcatgtttggaagtcggaattggttgaagttgaagatgatgtgtatctgaggcacagctcttccctgacttataggctttgacactgctgttgaggtttgactcgaagcccagagttttggtgtggatgagcagggacaaattgctgagcatgaagaagagtaaaattaagcaagtggaacatatgccctttgcctctgctctgcacagtgaaatgaaaagtcaacctttg

SEQ ID NO: 259149 - DNA, 251 bp, Homo sapiens
cgccggcaacgtttccagacgcccccttgaggtggcatctggttgaccacccctagttgagaaacattgcttccttcccccagccttccaagcaggcattttggtcccaaacaagtatatccaatctctcttttctttttaaataactttctaagtgctacccaagtttctttttcaaacaatgatggcagtactgtttctcccctttttttattcttcattccaggattaaaatactatttacaacctta

SEQ ID NO: 259150 - DNA, 224 bp, Homo sapiens
caaatcagtctgaaaaaacatcctgttgatagaggttaaatattagaattaatcatgcaatcaagagagcgcacagctagctagccattatctgctcctttgtatccatcacacctcttaatccagcttggaatgatgagtggagtttggtcctccacacttggtttgcaaataaagagatgaagtttcatgccaggtgtgcatgcttgttggagccattcgta

SEQ ID NO: 259151 - DNA, 625 bp, Homo sapiens
atgactaaacgcaggttgtatatttttcccagaaataccgtggaaggcacgtgttttatgtgcctattggccatccgtgtgtttcctttagtgggtgtctgctcaaatctttggccattgttatattagactgtttgcctttttgtttttgatttgttgtggaatacaacaattgaaatacaaggaaatatatatatagtatctatgtcagatatcttataatgatctgatacatttgtaagattcctatagagattatatataatatctgtcaacatatatatgacacatatatttgtgtgtgtataaaatattttatcccagtctgtggttgcctttttcttttcttaataatgtatttgtgttgacatttaatgctttctgtgtcctaagaaatcgtcacctattcgcaaatcatgaagaattattctgttttcttttggagactgtgttgctttatactttatattcaattctatacggatagcaacttaattttgtgtggatatgaagtgtgatgtagggattaatactcatttttttgccatacatttattgagttgtttcagtgttaatttgttgaaaaggtacatatagtatgtgtatatgtgtgtgtgtgtgtgta

SEQ ID NO: 259152 - DNA, 1064 bp, Homo sapiens
atggccgaggtgttgcggacgctggccggaaaaccaaaatgccacgcacttcgacctatgatccttttcctaataatgcttgtcttggtcttgtttggttacgggttcctaagccccagaagtctaatgccaggaagcctggaacgggggttctgcatggctgttagggaacctgaccatctgcagcatgtctcgttgccaaggatggtctacccccagtcaaaggtgctgacaccgtgtaggaaggatgtcctcgtggtaccccttggctggctcccattgtctgggagggcacgttcaacatcgacatcctcaacgagcagttcaggctccagaacaccaccattgggttaactgtgtttgccatcaagaaatacgtggctttcctgaagctgttcctggagacggcggagaagcacttcatggtgggccaccgtgtccactactatgtcttcaccgaccagccggccgcggtgccccgcgtgacgctggggaccggtcggcagctgtcagtgctggaggtgcgcgcctacaagcgctggcaggacgtgtccatgcgccgcatggagatgatcagtgacttctgcgagcggcgcttcctcagcgaggtggattacctggtgtgcgtggacgtggacatggagatccgcgaccacgtgggcgtggagatcctgactccactgttcggcaccctgcaccccggcttctacggaagcagccgggaggccttcacctacgagcgccggccccagtcccaggcctacatccctaaggacgagggcgatttctactacctgggggggttcttcggggggtcggtgcaagagatgcagcggctcaccagggcctgccaccaggccatgatggtcgaccaggccaacggcatcgaggccgtgtggcacgacgagagccacctgaacaagtacctgctgcgccacaaacccaccaaggtgctctcccccgagtacttgtgggaccagcagctgctgggctggcccgccgtcctgaggaagctgaggttcactgcggtgcccaagaaccaccaggcggtccggaacccgtga

SEQ ID NO: 259153 - DNA, 613 bp, Homo sapiens
gccctggagaatgccaacaccaataccgaggtgctcaagaacatgggctctgcagccaaggccaagaagcgggcccacgacaacatggacatcgataaagttgatgagttaatgcaggacattgctgaccagcaagaacttggggaggagatttcaacagcaatttcgaaacctgtagggtttggagaaaagtctgacgaggatgagctcatggcggaattagaagaactagaacaggaggaaccagacaagaatttgctggaagtcagtggccccgaaacagtccctctaccaaatgttccctctatagccctaccatcaaaacctgccaagaagaggaagacgacgacatgaaggatttggagaactgggctgggtccagcgcgggcaggatggatgtggtgcaggcaggttccatcgctctcgactctcactccaaagcagtagggccgcattgctgctcgctctctgcatagcatggtctgcacctagtgggatgggtgggggcgggtagaggggggttgcggggcacgggggctgtgggggagaagtgcctgctgtttataatgttgaatttctgtaaaataaactgtgtttgcaaatccaaaaaaaa

SEQ ID NO: 259154 - DNA, 434 bp, Homo sapiens
ctggactgatgtcataaccaaggccttccctgcatattggcttagagggttacagggtgaattgaggggacacccacacagtctagttctcccctcctgctgctagccaggagacttgcaggggcccaccttgtcatgaaggcaggtttccagaaaatctagttaccttgcaaatctgcctcctgcccttaacacctgaggcaaactacttttctatattaaaagaagtgaaatcttaaaatttgaaggacttgagggtgcaattagtctggctttcctaccttaaattagaaagtaggcaagcagccatgatcggtggtcgctcacgcctgtaatccagcacttggggaggctgaggcaagaggattgcttgagcctaggagtttcagaccagcctgggcaatatagggagaccctatctctattttttcaaa

SEQ ID NO: 259155 - DNA, 640 bp, Homo sapiens
atatggacaaaaatgtccacaaattcctttcattcctatataaatattccatttcaatgtgacttggcatctatttttccaccaccaaatcttgttctgggcatgtttcttgctttagaccaataaataatagcagtagtccagaaaagtgcttgtgcattggaacttgtcttttctccttggcctttaacgccacagattgacatgtgaagaagcctaggctaatagactagaaggtgtgagaccacatggtgagcggccccaaggatccaagcagtctcagccatctcatcttaaaaaatcatgagctaaataaaaaaatcatgagctaaataaaaaaatcatgagctaaataaaaggggggctatttccaactaaagtttcggagtggtctattaatcatcaaaaatgctaacttgatacaacaccttatctgatgtactaatcaatactttgtcactacgggtgccctatcagtcaaaatgtcactgaattggatgttctataaaaaaccttcaaagcggctgggcgcggtggctcacacctgtaatcccagcactttgggaggccgaggcgggcagatcacgaggtccggagatcgagaccatcctggctaacacggtgaaaccccgtctctact

SEQ ID NO: 259156 - DNA, 542 bp, Homo sapiens
gaactcctgtatgaataagccaccatcaatctattctttctgttttaccttctcatcctgctgacctttttctcatccttctattcgcacggtccatccccaggctctgtcatcctgagaaactgtaccacctctgaaatcccaattccaaatatgtctctttctgatgatcacctcttatctttccaaatctcttgctaaagtatgaacattgcttaaattcttcaacttcatcaagacgtctaattaattggccccatatttcctctccagccatgggcctctccaggcccaccttccttcctggtctgacagcttctgtcatctaccaccagaagcattgcctggaaaacacagatttccgtggtcttctttatctgatggcaaaattccacgcctggaaaacatcacctccaccttccctgggcgtgtagccctgcagctggacacaatggcacgatgactttctcttaaataatggaccacaaacttcaaatgggcatttacaacttcctcaagattgtattgtgtttctccagtga

SEQ ID NO: 259157 - DNA, 475 bp, Homo sapiens
ttagtatgtatctttactcattaggaacctgagtttcttgaccttttgttgatattttatatttatagttagaggagttggggagaaataacatatattcaagaaaataaaggaattaggatataaataaatagagtaggagataaaatgatagtaaataatctaagagctgggtcttggaggttggaaaatcccaatagattattaagcagccatatcaattattaagcagccatatcaaaaaattggaaaaattgaacaaaaactttccatttttggaaaaattgaacaaagaattcatcacccaaaagaaagatccagaaatatttcacacgtctttaaaacctcaaagaacagataattccagtacagagagttgtagtactgttctagaacatagggtaagtatgaaaaccttccagacttttatttaaattaaatactgataacagatcctgactaatgataatactta

SEQ ID NO: 259158 - DNA, 391 bp, Homo sapiens
acaattttttttttgtttacaagatttatggattgtgttatttatattgcttaaattcatgtttggtgcagaaagtcatctaaattctcaaaataaatcttccaatatacgttctcttttgacactggaactttagttcaatattgctaggtgacaatcagtaaggtaatgagcttccaaatgacgaaactaagcagaagaggccaaacatcttctcaaagataatgccaaataatgtgttaaaaaaacaggattaacacatcttttcctgtttttcttcttcccatagtaatttagattttacactgtgccaaagtagagcagataaatgtagctgtcttaacattataaacagtacctggtgttcatatactgcttcaaagttccaagc

SEQ ID NO: 259159 - DNA, 281 bp, Homo sapiens
aaaaccaaatattgtatgttctcactcgtaagtgggagctaagctatgaggatgcaaaggcataagaatgatacaatggactttggggactcaagggttgaaggatgagactacacattgggtacagtgtgcactgcttgggtgatgagtgcaccaaaatctcagaactcaccactgaaggaacttccccatgtaacccaaaaccacctgttccacagaaactatcgaaataacatttttaaaactttactatttctgaataaaatttacatacatttctc

SEQ ID NO: 259160 - DNA, 375 bp, Homo sapiens
gggtaatacttggtcacattgtccattattaaccaagtaaattacttcaatcattttgcaaaatgctgattttctaactctctcattccctctgcatgtatcaaccttaattcttctgttagaattaattgccaaggcatcatattttatgttacaaatttttctttggaaaaaaaaataaagcaaaaggaaacataaccctaaaaacagggcctatttcaaagttaatgagtcgttgaaagagatttttggccaggcacgctggctcacacctgttatcccagcacgttaggaggctgaggtgggcagattgcttgaacccaggagtttgagaccagcctgggcaacatggcagagccctgtctttacaaaaaa

SEQ ID NO: 259161 - DNA, 414 bp, Homo sapiens
ccttgaatgtgttagttccgtgaacttgggcttgggtttcatcatgtccctttccacgactgaacttaagtgcagttcttaatcagagaggggcgtttttaggcagagggaacagtaagctttaacagcgtctggtggtgcttgcctgtagtcccagctactcgggcggctgaggcaggaggatcacttgagcctgggaggttgaggctacagtgagccatggtagtgtcactgcactccagcctgggtgacagaatgagaccctgtcttataggcatgagccactgagcccagaaatttaaaaacgttttttagagatggggtcttgctatgttgcccaggaagttgccgtggtgagctacgactgcgccacatcactccagcctaggggacgaagtgagaccctgtgtcaac

SEQ ID NO: 259162 - DNA, 385 bp, Homo sapiens
taaaaaatgcatgaagtgaaaataacttgcaaactgtaccacttattcagcaatttcaagtaaaattagcttcattgtctaaaaagtttgaagtattcctgaaatattgactcactcctactctattgtatgaaggtcccatcctcagggttcatgaattaaatgtgtcagaacaataaacatcacactagtaaaaaaatacctatatttacaggccgtcatgcttctgtgtatttaatttttaaaatcttctcaagtctttcttcaaaatggcaacataaacaaaatcttttgacttttttcctaaactcaagtaaatgtatgccaattaggcatatgtgtcctaactagaaaatatgctgagaaaggtgaagaaatagatgta

SEQ ID NO: 259163 - DNA, 639 bp, Homo sapiens
attttaatgacatatgatgacgttggcatgatagagctggaagaattagttgagttgttgaaaatggtcctcaaagctatagaaattgaacagtggacacagaaaaagaacaatgcaggctgggcacagtggctcatgcctgtaataccagcactttgggaggctgaggcaggtgcatcacttgaggtcaggagttcaagaccagcctggccaacatggtgaaaccctgtctctacaaaaaatacaaaaattacccaggtgtgggggtgcccacctatagtcccagctacttgggaggctgaggcaggagaatcgcttgaaccctggaggtggaggttgtagtgagccgagattgcgcaactgtactctggcatgggtgacagagtgaggctccatcttaataaaaaatccataatagagaggaaaagtagtaaacttaacagctaaaagcaaatgcttgttctttaaaaggatgactaagcaaaatttggcaaacatgatagagatttgattagcaataagacagaggcaagtttttttttaattgcaaaagaatactataccaacattacaccaatgcattaaaaatttagcgacatatttcttttgagatcttagattataattcatgtcagtaag

SEQ ID NO: 259164 - DNA, 428 bp, Homo sapiens
cctctccagcccagtcagtcgtttctggctccattcataactctgccggatgcctcattagagaagtgtcctgagacttcttgtgagatatgccttcctgagacctacccaatgtgcccatgctgactcctaccagacagctgagagaccaactcagagaagaatagcaaagaaagcagaaaatgggaggctttatcccagtgcccaatccctgctagctgagccagttgagagtcacaaaccagggaaatccagagattttagtttcatctatggccactgggggtgagcagtaagaaactgaggactgtaagatggaaggcaacatgacagtggtacaaaggagctgtttgttgtgtttttgttgatggtagaccacttatagctatttctctttaattaaaaaaaactgttttatgcagcaaaga

SEQ ID NO: 259165 - DNA, 190 bp, Homo sapiens
gatcaaacactatattggaaaatcagaggttgaacctactgtcacttaagcaaattatgagaagtcatgtggcatggaagaaatgtgagaagactagatacaggcaaataagtgtgttggaggagaagatttccataatgttagattgaaaaccaggacacagactattgatagcatacggcaagggatc

SEQ ID NO: 259166 - DNA, 517 bp, Homo sapiens
cgcggccgcggggggtggggggtgggaggccgggagggggccgggacgccgggctccggggcgggggcggggggcgcgggcaccggcgaccccggtggcggcggcggcggccgggggaagcctcggggccggtcatgcggctgcggggcccgcggcccggagcgtccgcccagccctgagcgagagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagaggtgacgtccgtgggacctagactctagagttctgaatggagagagg

SEQ ID NO: 259167 - DNA, 829 bp, Homo sapiens
cgcggccgcggggggtggggggtgggaggccgggagggggccgggacgccgggctccggggcgggggcggggggcgcgggcaccggcgaccccggtggcggcggcggcggccgggggaagcctcggggccggtcatgcggctgcggggcccgcggcccggagcgtccgcccagccctgagcgaggccccgcagggcgccccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagaggtgacgtccgtgggacctagactctagagttctgaatggagagagg

SEQ ID NO: 259168 - DNA, 247 bp, Homo sapiens
cccgagtagctgggactacaggcgcctgccaccatgcccagctaactttttatatttttagtagagacggggtttcaccgtgttagccaggatggtctcgatctcttgacctcatgatccgcccgcctcggcctcccaaagtgctgggattacaggcatgagccactgcgcccagcctaatttttactttcaattctatccttccctgtcttaaaagtgaaactcctctacagaaataaaagtttta

SEQ ID NO: 259169 - DNA, 340 bp, Homo sapiens
taaatgttaaaagtaatagtttcttttaaagactaacttcctcttccttccttatttggaaatgttattacttttctaagaccttttgcaagcaacttcctcttttccttttgttctccattgcctttacctatttaggaaagttttaagttgttagccaattgagtttagcttagattgtgaggtccgtctccaagcaacgaagagaggacacagcagtaaggacccagtgtgtaagggataaatattcctgcctttctttattcatcgtgctcttgtggcaaaattgctgatgggcagcatcctttctgcagaaagtaaaattgccttgctgagaaaa

SEQ ID NO: 259170 - DNA, 1028 bp, Homo sapiens
accctctcggtgtatagaggtcagtgcagccccctgccgccgccctgttttctcgagactgtacactaacccctgccgccaccaccctggatcctcagcacagggactgtcgtgctctccttgttccctttccaggtgtctctgtagccttcaggactgtcgctgctgcagccatcctgggctaagagcttttgctggcctcgggttctactgagcaagagtcccccaggcccagcgggctcagtgcagcaggcggggtgggacggtgccgccaagagagggcagcctggggctgggggcatggacagaaactgaaggaaaggcagcctgtgggagctgcgcttttaaaataagcggcatggggggccgggggggcgctgtgacgggggagcaggtctcttctgtagggactgggttttgattaagtcagtagcaggattaagtcattgggtcatcagaaaatctcatggataaagttcaaggggtttgtgaactttaaaaaaaaaaaaaaaaaaaacaaagaaatagccgtcggcacggttcaaatctgggcttggtgctctgggctgcttttccacaggccctccaggccctggatctgcagagtgtgagccccactgattgaagcatgttcgtgcacagacgccatgagggggatggaggctgcaggaacgggggaaggcaggcgggggtcctgtgaagtgtgagctcccagcagttgcatgctggggtcctcagtttcatgttgccagtgcgtcagagagccatctctcactccgtccctgccaccgtccagtcctgcctgctgtaaagggtgacactgaggaggagaggcgtgatggttcgtgccttgctatactagttgtcctgcagctgtccctgatcagactggccttattcaacctttgttctaaactacggcagttgtcctagccaggccatcggttagatggagctgctgcaggaggagccatccagcattgaggtacccctggaacacaggctgcctgctcggaaatgcgcatctt

SEQ ID NO: 259171 - DNA, 308 bp, Homo sapiens
caacaaagatggtaagaacatacactggggaaagggcagtctcttcagtaaattggctgggaaaacttatccatatctagaagagtgaaactacgcccctatctttcactgcatacaaaaatcaaatcaaagtggattaatgacgtaaatctaagacctgaaactttaaaactaccagaagaaaactttagtgagacaatccaggacatgagtgtacaaccttttggcttccctgggccacattggaagaataattgtcttcggccacacataaaatgcactaatactgacaagccaatgagcttaaa

SEQ ID NO: 259172 - DNA, 788 bp, Homo sapiens
ctgtagactcagtgagtctgttcaagctcttttcaccgacctagatgtgtttctgaggtgatggttgggtttcgtgctactatgtgaattagaagatcttgaaggagggtcagtatgaaaggaagtagagagtttaaagtaacatgaaaggaaaagttaacagaaactaaacaagaagagcaaattaggagttctaggtgaaaaaacagaattcctgaaagggatgtaggtgttatgtggtgttaagttaatttttctaaataaatttgcttagcatccagacagtagctgctgtctgtagatgagatacgtaggatgtgatgtaatagtgtaatcatttaataaacagccatttgttgagcattgtgtgtttggtgctgtgccagtccctttatgcacattaataatagcagacactgggattgtgcttactctggtgctgcagcaggcctacctcatcatgatcagtgcgccaggagcaggagggacacctgcagggctggaagggcaggggaggtgggcctccatggtttgtgtttattgcataaccatttttattgtctacagtgagcaaagttatcctataaacaagtgtcagggaccattgcactaaagaaaacaaatgagagcattttggaagctctaatttcctgatcagtaatgggtagactaattcccagttatatttacctgttgtaaggtgaaaggttcttcagaggacctctgtcttggtgttatatgggcttttgaatgtactgaaattaaattccctaaaaaaatgtgaaaaa

SEQ ID NO: 259173 - DNA, 572 bp, Homo sapiens
ctgtagactcagtgagtctgttcaagctcttttcaccgacctagatgtgtttctgaggtgatggttgggtttcgtgctactatgtgaattagaagatcttgaaggagggtcagtatgaaaggaagtagagagtttaaagtaacatgaaaggaaaagttaacagaaactaaacaagaagagcaaattaggagttctaggtgaaaaaacagaattcctgaaagggatgtaggtgttatgtggtgttaagttaatttttctaaataaatttgcttagcatccagacagtagctgctgtctgtagatgagatacgtaggatgtgatgtaatagtgtaatcatttaataaacagccatttgttgagcattgtgtgtttggtgctgtgccagtccctttatgcacattaataatagcagacactgggattgtgcttactctgggctcatatgctatatgcgttttatccatttaatcctaataacagcccagtgaggtagggtctgtctcccttactatgcaggagctctgattcccccactgagtccccacgctaggccactgcccttcctggatgc

SEQ ID NO: 259174 - DNA, 345 bp, Homo sapiens
gtgataactggagggcagagagggacacagatgacacaatcttcgaagtttaatttggttataaggttttttgttcttgttttgttttgctttctttttggatacaaggtcttgctctggtgcccaggctggagggcagtggcacaatcataactcataatttggttgtaactgttctttaaaaaatatttttggctgagtttggtagctcacacctgtaatgtaaacaatttgggaggccaaggtgggatgatcgctggatcctatgagttcaagaccagtttgggcaacataagtaggctcagtttctacaaaaaaatttttttaattggctgggtgtagcat

SEQ ID NO: 259175 - DNA, 353 bp, Homo sapiens
atcagaaggaggcttgagtgtttattgtagaaaaccaattaactatgatttaaacaagcagagggtggggtttctgggaaagccccttaaaaccagaagtcagcaagactccctcctgtccttccctgcactccccttcttgcttcctaaaatgggaacatgctagctgatgccatcttggaccatgagaagactgagaatggaaacccgcaatgccctaagaacagcagagaagagggaatgtgcgtctctgtctagctcctcaagacttctttcatgtaatggagaaatacgcccctagcttgtttaaatcattgttaattggttttctacaataaacactcaagcctcca

SEQ ID NO: 259176 - DNA, 749 bp, Homo sapiens
gctaagatcatctgtgtgccctttgattaatgcttcttaatacttgtcatctctacctccattctaaaatccaacttttagctttcatttaagaaagggagtgcctatggccaatgaaggagtgtatcctttcattactattctgcttaatttctgtgtcacttgatttttttcctagattgtactctctcaatttgaatgtatagcaacatcaaacaaaaaagcagaagtaattaggtttgtcagtccacaagaattttggaccaaatatccatgaagtggtgggtagattataatacctaatacagagtatcaaaatgagttcttacaatcccacacgtagtctccatgtggtatgagatgccactggcctgagctgacgtagtattttttatatgaatgaaggctgttcaaggacttgagaataatttgttttcttaattaatataacccctgcctccattttctttatactacactcagatcagtgatgtctcctttcatgtgttgtgtgaaaagcaaattttagtcttgtcttgatgaattataaattccaggagttcagagcaaaaatgagtatatatgtatgcttctgcacatgcatacatatgcttataaaaagtgacaactggccaggtgtggtgctcacacgtgtaatcctagcactttgggaggttgaggcaggtggatcacttgaggtcaggagtttgaaaccagcctggccaacatgatgaaaccccatttctatt

SEQ ID NO: 259177 - DNA, 682 bp, Homo sapiens
cgaggttcagtgttatctcctcttggttgtgtgaacttaccacagtatataccagtctatgtgaccttgggctagttgcttaactgctatgggctagcttcctcctctaaaatggggacaatagctcacatgattctggagaagatttatttattattaattaatttattattattattattttttgagacagtctcgctctgttggccaggccaggctgaagtgcattggcacaatctcagctcactgcaacctccacctcctgggctcaagctattaccctgcctcagcctcccgagtagctgggattacaggcacctgccaccacgcccagctaatttttgtatttttagtagagaccgggtttcaccatgttggccaggctggtcttgaactcccagcctcaggtaatccgcctaccttagccttccaaagtgctaggattaaatgatctgtgtatagtaagcacagagtaaatgtcatctactgttattgtattgccaggtaagtctggttcaatttgcgtagaacaataaggcttttccttggggacatttctagaaaatgctaattgctaagcatatcaaatctgtttgctccttggcttgtaaatcattgtcctctgtctctatcgcttcacaccgtcttccctttatgggcatcttggtctccaaatttcccc

SEQ ID NO: 259178 - DNA, 187 bp, Homo sapiens
tgcttctctcccagggcttcggcctgacagcgcttcccccacccggctgctgtccacagagtccttggaaatgctgcatccacatctgtgcatattcaagccagcagagggtggaacctaaaactaagccctggaaagatcaggacccacagcctgtgagaatatctgtattctggctggagacaat

SEQ ID NO: 259179 - DNA, 341 bp, Homo sapiens
tattgaatatttgatgccccatgtgataccccatgtgttagaaggtcttttccttctgggctgagtgtggtggcttacacctgtaatcccagcactttgggaggccaaggcgggcggatcacttaaggtcaggagttcaagaccagcctggccaacatggtgaaacctcgtctctactaaaagtacaaaattagtctggcatggtggcaggtgcctgtagtcccagctagtcaggagactgagacaggaggatcgcttgaacctaggaggtggaggctgcagtgagccaaggtcatgccactgtactccagcctgggtgacagagtgagagggtgtctcaa

SEQ ID NO: 259180 - DNA, 851 bp, Homo sapiens
atcacatcccctcttgcctaccaatggacattattccagcaattatctgttctctcaccagcgtcagttcctccctgtctactgaatgcttctcatcagcgtaaaaacctgctgcagtatctcccatctgaaagacaaggccaaaacaaactctcccttgattctgtaggtcctgcaacagagttgcatttctctcctctttataagcagcactttgggaaagagcagcccttttctcttttctccatttcctcactttgaattctcattgaacctattctaatcaggttttcttcctcaccacttgcctgaagtatcccttgcgaccttcacgttactacattcactggttagttttcagtcctcatcttagccattttcagcaacatttgatacagaggaacacttttctctcccatatttattttataatgagatatagcacatatatagaaaagtacaaaaaatacagtttaaaaaataattatttctttcaaacccataaaaccagtgccatgggtaagaaacagaattctatcagtgccccagaagccatccgttttatccttctcattaccttcctgtaccaagaaataccatttctgactttctgaaaatcatttcctagattttctttcccactttcccacttgtgtatgctttcctaaataatttgagtttgcctggaactttccagaaatgggtcctaagtttaatctttcgtgactggcttctttctgttcagcattctttgggattgatttatgttgctgcacatagatatagttcattttaataggtatatagtatccactatgaatatgctagtttactcattctacttttgaagg

SEQ ID NO: 259181 - DNA, 487 bp, Homo sapiens
tcacaggcttgagggtagttgggggtcctacgatagaggcacccagggcaacaagaagctagatttggggacaaaagcaatttaacacagataagaacctccatttaaaccataagcctcatctgtataataaaattcatcatgttaaagaatgccagtgtggttttgtataacaagcacagcaagtcatggtgggttgtggttctggtgctgcttctgttcttggctttgtgacctttgagtctgcttccttatatgtaaaatgaaagtgttgaactaagcactcggtaagctttcttctctgtcgaacacactgtgtttctgggtaagtgtgttttcatgaatatctgtggatatgaatatctgtggatatgcctctccgtgctcattagacatttctttttcaaaatatatggcactactatatgtaaagggtgtttttcaatagaaagttctatttttttgagcttcaataacacttggatgg

SEQ ID NO: 259182 - DNA, 394 bp, Homo sapiens
tggctcctgaataggatgccttctcagaccctggcatttcaaaggcagtgaaaggtcatcctaggtactagtttctcaaagaaatacctgtagtaaggtaactattctagtcacctttatatagtaacggcttgtatctcaggcaattcgccagtttttcaattaaaactgacacatattagggatttttacttctgccccccgctccccgcaattcggattctttctttagactccctgagcctctgtccccatcccaggatttgactgaagggctgcagagcccagggctgcgcgctaagcagccttctgctgaacctcagcggactgggccatagttcacacaccctccactccttctacagcagctcccgctgggggcaccgccaggata

SEQ ID NO: 259183 - DNA, 423 bp, Homo sapiens
actgtatgctgcctcccggagagcctcccaggggacttgctctccaaatgaaggcggctggctgccgagagtcagtcactgggctggccatggagcttggatgttcctgcctcggtggtgtctgtgactggctggctggggagctctgttccctggaggccctgggcagacattgctgccctcctgggtcagccatgcctggtggtgggaggtggggtgggagaggactcggggtgtgcctgaagctgcagggcactgtgctcaggcccatgctaacaacagaccatgtctcatcgtctccagaaatcaccctgggccccactctgggcagactctaagccacacatatgcgaggaatggaccctgagcacattctggttggggagagagaacagtaaagaaatgattgaccttcagcaaaag

SEQ ID NO: 259184 - DNA, 331 bp, Homo sapiens
gtcctaatattttagccagatccttgacattattgaaattaagtctttaatagtaaccattgtactgtatatatatgtacttacacattttccatgtatctttgcgtatctttgtttattctgtaacatcatgtcataaacctcagatatacaaaataaaacttatttaaaaaacaaaaagatgaaaggagtaacagctgagtggagacttggaaagtacatgtgagtaatccaggcaaggaaggaggccagacattgtcattccactgtgcttttctcataatgcacacacaggccctggaacactgtagttactcaataaacttttgtt

SEQ ID NO: 259185 - DNA, 685 bp, Homo sapiens
gaggcatgaagagaggcactatgtccatgtgatatgatgcaaaaccactgaactcatttgaggtgtcaaacttagaggctgatccttactttttccttcccaatgtgtaaaaataaacatcccaatctccggcttctctgattgcattagtcacaagttgtcacatgattcctttgttcttaaaacatttttaatgactgaaaataacagttttcatctcatcttcaaaaggttatttctaacaatcccaaatctgaagatatggttttaagtttctgagtggcaggaagtaaactaaactttttttaaatgaaagatatcaaaagaaatagttaggtctttgtcagactctagccttgtggaaaaattctagatgaaaattctgggataaattttgcaattctaacattactttattcttttttgatccattaactaggaagttttccttaatcatctctactttgctagacataatggaataatacaaaataaatagggctcaatttctattcaggactgtaagatctaatggtacagataaaattaatacacatgaactcatacagaacaatcgagagtgagcaatgtggtgctgactttaagtataacaggtgtttgggacaaagtagagattagtgaagatcaacgtaataaaagaaagctttatggaggaagtagtgtt

SEQ ID NO: 259186 - DNA, 503 bp, Homo sapiens
ggctggaaggaccaaaatagctttattcattgctgtggtctgaatgttggtgtcctctcaaaattcaaatgttggaactgaagactcaatgtgagaggtgagacctttagaaggctctgccctcatgaatggaattagtgcccttataggagaggcttgagggagcctgtttgccccttctgccacgtgaacatgcagcaggaaggctccatttatgaagcagagccttcaccagacactaaatctgctggtgccatgatcttgagcttccctgccttcagaactgtgaacaatagatttctgttgcttataaattactcagtctaaagtattttgttccaggagcctgaatggactaagacacgtacatgtctggcaacgtagctgaggtggccagaatggctgcaggtggtcaagcctctccctgtttagtggtgtctcatcacttcccagtgatgagagaccacgtggagctttttaacatcatggctggctccaaagac

SEQ ID NO: 259187 - DNA, 539 bp, Homo sapiens
ataaatacaggtacaaaaaatattaacaaaatattagcaaatagaattcaacaatatgtaaaaagaaccatattatacatcatgaccaaaggctagtttatttcaagggattcaaggctggctcagtatatgaaaaaccatcagtgtaattcagtatgctaacaacctaaagaagaaacatcacacaatgctataaattcctgcaaaaagtgcactgacaaaattccacagacatttatgagaaaaactctcagaaaaattgagatagaaaactttctcaactttacatggaacatctataaaacatctacagctaacattatacttgatgaaagacatgagtgtttcctcttagatcaggaacaaggtcaagggatgtcttctcatgacccttcttcaacacagtgctagaatttctggccagtgcaaaaaggcaaaaaattgtaattaaaagcatatggattataaaggacaaaaataaaactgtccctatttttcatttgatatcattgtttatgtggaaaatctcatggaacatt

SEQ ID NO: 259188 - DNA, 504 bp, Homo sapiens
caaagagaaacactggctctgaaggaaacacttcaattgtgtccctctgatactggtaagctctgttggaaaagtcagaggagttggactcttaaaagccaactgttgtgaaaacacatcatcgtcgtctgtagatgttttctgaagcatgcatccagctattttaatctctccaaagtgagtggatcactaagccacaaccctctggatgatatggtctattgatggcaagtgaaggtttgggtaaatggtgagggtggggaatggtatttccctttcctgtcaggtttctctagttccttgacctgaaacaagtgttgggattttctctgaaaaggcccgtttagggctcagagggtcagtattctgagcagcccagctggactaggattaaaggatagatgaatagcacatgaagaattttgatggacacgtttaggcctcccttggtccactgaacaagacttctggaaataaaatgagccttttcaacaaaaaacaaaa

SEQ ID NO: 259189 - DNA, 192 bp, Homo sapiens
aatgtaaaggatgaaagggctttaagcagtggagtggcatgattccatttggctagatgagcccatctggcactcaggtgtggtgatgagagattggagagagtagttagaaggggtctgcagtgatcaaggcgaggcttgctgctgccttacattggagaagtggccatggggatggctagaagtgggtca

SEQ ID NO: 259190 - DNA, 424 bp, Homo sapiens
ggctccactctatcccagtccaatcggtctgattgtgccaggctaaattccctcaaaggcaagtttaattattactcctttctggctggaaaaaacaaatgattctatatttactacttcctcctgtgttactcctgtaacatatgttattactgagtacatgagcataccatgtactcaataatatagttagcactatctaactatccaaatatatttcccaatcacaggcagacctcaaggatactgcagattctgttccagaccaccgcaataaagtgaatatcacggtaaagtgatcacacaaatgttttagtttcccaggccatatgaaaattatgtttatactatactgtagtctattaagtgtgcaatagcactatgtctaaaaaagcaatgtgcataccttaacaaaaaaaaattg

SEQ ID NO: 259191 - DNA, 3893 bp, Homo sapiens
  misc_feature (3270)..(3271): n is a, c, g, or t
  misc_feature (3334)..(3335): n is a, c, g, or t
  misc_feature (3473)..(3473): n is a, c, g, or t
tctcccaacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttacagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcaatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgacttttctacttaccaaattctctccattcagaacacctcttggatttgcatactttctctgaattcacagcccagcctatacttttatcatccccagctcccactcctggcagcagtagctttctaattccagttcttcctgctttattgaagagggatgtgctaagctgtggtacagtaacaagcccgcagagagctatgtctcccttaaaacctgacgggaaccattctgtcttattctatcctcattatttggaacatctggcttccaaagtcaccacaagggcggaagagaaagctagaggaatttgtaggatattttcttagacccaggcttacatcacttctgtccacatctaataagccagaacccagcacctagaagctaggaaagtaaacaagcacctcgaaagttggttaataccaagaacctctctcacagttatattttgcatactactgttaagccagtctttgcaaatgaccccttcctgcccatcactgccttcctcaagacctaaaatagctccctatttagtgaaaaattatctgaatatttaaggtctgccttaacgtgatccccattgctgaattttacctcctgactccaaaaactcttctcttccctgggcccagtcctatttttttttttttttttttttttgtgagacagagtctcactctgtcacccaggttggaatgcaatggcacaatctccgctcactgcaanntccgcctcccgggttcacgccattctcctgcctcagcctcccgaatagctgggactacaggtnnccgccaacacgcccggctaattttttgtatttttagtagagacggggtttcaccgtgttagccaggatggtctcaatctcctgacctcgtgatccgcccgcctcggcctcccaaagtgctgggattacagacgtaagncaccgtgcccggcctatatttttattttattaaaggttaggcactagatgaccttgactctaggcatctgcattctcttgatctttgcttagggtgaagctcagaaaaggacttggttctgaaaggctgtctggaattagattgtcctacgtgattcccagtgaattgagatgaatttcctctggaagttcaagtcggattcgagaagctgaattaccaaacagaccctccccaacctactaacgaccctattactctgttcaccctagagcagacgaacggcagggaagacttgatctgtggacttttgaaagcaacttgaggaaaaacacataacagaatctataggtgtggacaatatgtgatattgctaaataatgtcaagtaggaaataaaagagactattgacaaacttttggc

SEQ ID NO: 259192 - DNA, 624 bp, Homo sapiens
  misc_feature (397)..(397): n is a, c, g, or t
  misc_feature (460)..(460): n is a, c, g, or t
  misc_feature (463)..(463): n is a, c, g, or t
ccggaagtgtttctggttttccggcccttataacatttgaaatggggccggggaatcaacccagtggagggggggcaacttgaaccctgccaaaaagcccctctcaagaaggtaatctggaagatcttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttanagatgcagcagataaaacaggagagacacctgaaacaaatgtcaaccattcacaaatctgccnccncccttagcagagattataaatggaatggatttgggaaaagcttaggtttaagatcagcccttgttaaccaacccagcattctcatgggaaaaggttcttataaatgtgatacagaattcaggcagcctttagggggaaacaactctcagagaacccccccc

SEQ ID NO: 259193 - DNA, 2613 bp, Homo sapiens
tctcccaacgccagctgactcgatttcgtctcggtcttccccagagctggacacgaggcaccatgatcagagagacacattccctgcggacggcgctcccatcggatactggagggacgcgacactagaggcaggcagtacttcagggtgaccataagtctcccaaacagccacaacggctcgctctcccagctaaggcgacagcgctgccattttggatcctgttcagccacgggaagccggcgtttgcacacattttcggacgtcatattaaagcgcaccggacgccgagacttctgggagatgaagtccttgcgaaggccccgcattgattgggagcgcagtcgccaggaccctgtgcgcaggcgcgttggtttcccgacctgaagaggcgccgtcttcccgggtcccgagcactctgtgccggaggactctgcccttgtccacaaggagagcacacaggagagaatggctgctgtgtctccgaccaccagatgccaggaatcagtgacattcgaagacgttgccgtggttttcacagatgaagagtggagtcgtctggtccccatacagagggacctctacaaggaggtgatgctggagaactataacagcattgtgtcattgggccttccagttcctcaacctgatgtgattttccaattgaagagaggggacaagccgtggatggtagatcttcatgggtctgaggagagagaatggccagagagtgtctctctagactgggaaactaagcctgagattcacgatgcttcagacaaaaaatcagaaggatcattgagggaatgccttggaaggcaaagtcctctgtgtcctaaatttgaagttcatacacccaatggcaggatgggaacagaaaagcaaagcccttcaggggagactcgtaagaaatccctctcccgggacaaaggcttgcggcgacggtcagccctgtccagggaaattctcactaaagagagacaccaggaatgcagtgactgtgggaagaccttttttgaccactcatccctcacccgccatcagaggactcacactggggagaagccctacgactgccgcgagtgtgggaaagccttcagccacaggagcagcctcagcagacatctgatgtcacacactggggagagcccctacgagtgcagtgtgtgctcaaaagccttctttgaccgttcgtccctaactgtccatcagcgaattcacactggagagaaaccctttcagtgcaacgagtgtggaaaagccttttttgaccgttcatcccttactcgacaccagagaattcacactggagaaagtccttatgaatgtcatcagtgtgggaaagcctttagccagaaaagtattcttactcgccatcagctaatccacactggcaggaagccttatgagtgtaacgagtgcgggaaagctttctatggtgtctcgtctctgaatagacatcagaaagctcatgctggggaccctcgctatcagtgtaacgagtgtggcaaagctttctttgaccgctcatcccttacacagcatcagaagatccacactggagacaagccatatgaatgcagcgaatgcgggaaagcctttagccagcggtgccggctcacgcggcatcagcgtgtccacacgggagagaagccctttgaatgcactgtgtgtgggaaagttttcagttcaaaatcttctgttattcaacatcaacggcgttacgccaaacagggaatagactgagttgggcaaaagcttgggtaggacaagaacttccatacaaatttgagatagatctcgcctgtcttaaagctgccatttgctcattctacccactctggctgccgttgtcctgtcctgcttctgcgccagagtgtttaataagcactcccttcctgctgtgttacagaactgtaggggaggccatggaaatgactctaaagatacaaaattttgaagaggtttgtcagacaataggatagatgttaggaggagacacacctcttgtctgagaacctaggccccaggtatcactgcactttaagaaactggaggctgcaacaggagggaaaggcagaatgatatcacagcagtactatttttttttttcagaacatttgttttgatggctgttagtccccctctcttggagcattttggggcactaatcttgttctcttgtgtcccagcttttagacctcttacttccactgctagtagctagcacttactgagcacctgcaatgaggtaaagactcagctaagggttttacaggaagtagattaattgatcctgtcaccaaccatatgaagtaggcactgttaccatctgcatctccagatgagcaccctgaggtttagagagattaaatcacttgcccaaggtgaaccagctggtaaaaggtgatgccaggtcttgaagacaggtccaccttcaaaatctattctctttaccattatgctcgatggtttgtttgttttataatttatgtatatgtattatcctctcaactagattgtaagcacttggaggtgtgacttacaggtctttgtatctcacacagtgccttgctaataggtgctcaataaatatttatatgagtgaatgac

SEQ ID NO: 259194 - DNA, 713 bp, Homo sapiens
  misc_feature (20)..(20): n is a, c, g, or t
  misc_feature (51)..(51): n is a, c, g, or t
  misc_feature (486)..(486): n is a, c, g, or t
  misc_feature (549)..(549): n is a, c, g, or t
  misc_feature (552)..(552): n is a, c, g, or t
ctctttcacgcacacaaaangccctccaagagaaataacccaagagctgcntccagtcagagcatcatgatcaaagtcctggatggcgcgatagtctggatggagatcctgacctgatgacatttgaagatgtggctgtggaattcagccagtgggagtgggggcagctgaaccctgctcagaaggacctctacaaggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttanagatgcagcagataaaacaggagagacacctgaaacaaatgtcaaccattcacaaatctgccnccncccttagcagagattataaatggaatggatttgggaaaagcttaggtttaagatcagcccttgttaaccaacccagcattctcatgggaaaaggttcttataaatgtgatacagaattcaggcagcctttagggggaaacaactctcagagaacccccccc

SEQ ID NO: 259195 - DNA, 490 bp, Homo sapiens
tctatgatattttgttatagcagcccctgaacagactgaggcagcatgtaaaaaagtcccacatatacagaacaaacagaaagaaaatatgcaaaactactactatagtccaggtggctggtcactagaccaggctagtaatcagtcacaaggccataattgatatctatgccttccttctttcactactcattccctatttcccctaattttagctagaaccgcagatgagtgaatttttttacctgttgaagtaacccaaaccttcatttctttcttttttttttttttttttgagatggagtctccttctgtcgcccaggctggagtgcagtggtgagatcttggctcactgcagcctccacctctcgggttcaagcgattctcctgcctcagcctcccgagtaggactacaggcacgcgccatcatgtctggctaatttttgtatttttagtagagatgggatttcaccatgttggccaggcttgt

SEQ ID NO: 259196 - DNA, 245 bp, Homo sapiens
tgatggtcttaccttctttcatgtataatacgcataagaggagattttacatattttgtgtattaaagggctttgaccacgcaattcatttccaaggtgacagtagttaccttgtgaaatgataatgaaaccacaacaacaaaagtcagcagtgaggattagcaaagaaaaaactgggaccaggagtggaggtgctgattgatgtaatgtagtcaccatgtacatgttgctatggaaattatgca

SEQ ID NO: 259197 - DNA, 218 bp, Homo sapiens
agcatctttcactcctgccagctgtgcctgtgagttccacttgctccatgttcttgccaacattcgatggtattggtctgtttaattcagctattctagtgaggggatagtggagtctcactgtggtgttaatttgtattttcctgataactaatgacgttgaacatctttatatttacttattggccacttacatattttactttggaaattgtctc

SEQ ID NO: 259198 - DNA, 337 bp, Homo sapiens
atattattctctgcaatttcactctctgcgcctttgtcttacttcattcattcccatccacaagctgagtcaatgggttatacaaaataaattcatttcaacatttattttatggctactatgtatgtaccagaaactacaaaaggaaaaagaggccgggtgcagtggctcacgcctgtaattctagcacttcgggaggcggatgttgcagtgagccaatatcgcaccactgcactccagcctgggcaacagagcaagactccgtctcgaaaaaaaaaataaattttaaaaactacacatggggtacaatgtacactcctcggcagatgaggtggtg

SEQ ID NO: 259199 - DNA, 544 bp, Homo sapiens
catataaacaaggattaaaaataattaaaataattatataaacaagggttaaaacgtatgtgggtgttatggtagaggaatgtgcaaaatgtggagtggggacccatggcgagagccatctttaatatcattggcttgtcaaatgggcagttctaagggagcttggccttacctgctctggggaattgcaggttgccacataacaaagcatttctgtgtgggtacagataaggtggctgtgtctgtgagaaagcctgggaaaatgcaaaggaaaactatgtctgcatagcagaggcaatactgtcacaccactaatccaagctgaagaaactcaattgctgagttctaactttttactttacttgtaaattgtattcatgatgatttgtttataaatcaaaaactttaaatggacctatatatttcagtatatcatggaagtttttcgtataattcttgtagatgcttttgtaaagagaaaacattcctttttttcaatattaatttcatataagattacactgattaaacaattttccttata

SEQ ID NO: 259200 - DNA, 400 bp, Homo sapiens
aagccaatctctccctgcttttctcatctgcctcccagaatctgatgtcttgctgagtagctggccaggtgtccccattcttagtgacttggaggaggtgggagacttggcaaagcagcaggaatacacacacacccctcacctctgtcctctgcaatcccctgaaaaacaggctcgtctgctttaactggaatcacaaacttttaagttctagaatgaagtagcagatgtttatgtgaaacgatcctatttctctaatattcactcagcaagtagttgtcaagatggggtttacatattgaaatccatggatgggaggattggcaagaactttgaacaatggggtcaatgagatgctgaggagaagccctgcctaggggaagaaaatgaggcgatgggg

SEQ ID NO: 259201 - DNA, 309 bp, Homo sapiens
tttactaatacttatatcagctttttatttttctaagaaaagtaaaaacactaagataaacacacacacacacatatatatatctctcgcagtttttctaaattttcattcactgttaggaataatttttgaagactttaagaactctaaaatagagttgtattttaggtaaatgtttaacagttacattctagaatgatgtctttataatttttttgaagtatgctaccagtaaattgaccgttacagaattcctctgttagctaagatttgttcttgtgtaactttgaggcttattataagaagttt

SEQ ID NO: 259202 - DNA, 479 bp, Homo sapiens
tgccaatccaggagacctacctttcaatctctgttatttacctctagagtttgggaagaccacataaactctttgactctgaatctactcttgtgtaatgtagggatgacaatggtgaccctcagggtggttacataataaaaataatgcaatgcgcagttacgtgaccactcaggttgggtatcaataaaaattcactagaccgggcgtggcagctcacgcctgtaatcccaacattttgggaggctgaggcggatggattgcttgaacccaggagttcgagaccagcctgggcaacatggcaaaaccccttctctacaaaaaaatacagaaaactagctgggcatggtggtgtgtgccttcccagctactcagagggctgaggtcaggggatggcttgagtctaaaaggtggaggctgcagtgagctgtgattgcaccactgcactccagactgggcaacagagcgagacttctttc

SEQ ID NO: 259203 - DNA, 307 bp, Homo sapiens
agaagatgagcattgaaacttcatgttgcaggcagaaaggggatcatacaatgcaggggaatcacgttatttatatggcaaagaactagaattatattttcaagtaataaaaaagttcattttcagtgtttattgcaaatgcttaattttttctatgccctcatcctctgctattgctagcgtcaacataaacaggtgctgattgaaatgggatgttgtgaaaccacacatgaaaggcccccaaatgattttaccctgggggaagaatattctgaatccggacttcccaggcagggagcccaggagt

SEQ ID NO: 259204 - DNA, 552 bp, Homo sapiens
ccagtttttcctcaagtggattaagccaatttaccaatgaccaggtttttctactctgaaacagtaacaagcctgccagaaatgatgtgcagcattttcctggcttagttcagaaactcgatttgtgtttaagctgtcaatttaatccacactgcctttttacttttatcaggatattcttcaggtagaaaagaatggagggaggctttaggcatgactaccgtcctaagtataaagttggttaaaaaaacaaaaatccctactcggcccaaatagcattgtgctttataattcattcttttcacatacagtaccctgcgttatcatggctaatgttttcctgctgagctgccatcatcttttgtcaagctgtcagggttttaaattgaggtaccttccacatttggatagaggtcattatcctgttgcctggttgcattgcctctgctgagcaggttaactgcttgaggtcttttatctagataaatgttttgccagcacttttgctctgtgatgacacgagctgttccttagaggtcaaatagtgatgct

SEQ ID NO: 259205 - DNA, 1069 bp, Homo sapiens
taagaatgagtttcttactgaacaactttctaaaacgcaaattaaactcaataccttaaaagataagttccgtaagacaagagatactctcagaaaaaagtcatcggctttagaaactctccaaacgacctaagccaaacacagcagcaaataaaggaaatgaaagagatgtatgaaaatgcagaagataaagtgaataattccactggaaagtggagctgtgtagaagagaggatatgtcatctccaacatgaaaatccgtgccttgaacagcaactagatgatgttcatcagaaagaggatcataaagagatagtaactaatatccaaagaggctttattgagagtagaaagaaagacctcatgctagaagagaaaagtaagaagctaatgaatgaatgtgatcatttaaaagaaagtctctttcaatatgagagagagaaagcagaaagagtagtggttgtgagacaacttcaacaagaagcggctgacagccctaaaaaaattaactatgttagagtctccactggaaggtatatcacgttgtcatattaatttggttgagacacaggtcccaaagaagaaattatttcaagtggaaagtcaatttgatgatcttatggcggagaaggaagctgtatcttcaaaatgtgtcaatttggctaaagagaatcaagtttttcaacaggagttattatctatgaaaaaagtacaacaggaatgtgaaaaacttgaggaggataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggaacaagcacaatataaaaaacaattagagcagttaaacaaggatataatacagcttcactaaataagaaggaactcacacttaaagatgtggaatgtaaattctacaaaatgaaaactgcttatgaagaggttacaactgagttagaagaatataaggaagcctttgcagcagcattga

SEQ ID NO: 259206 - DNA, 226 bp, Homo sapiens
agactagattactcagaggagtttcctggagtagggggaggggagtattacttattttttccttttgcccctgactaatttggcttggcagagtagagttactgattttgcatttatttaaaattttgataccttgttcaacatggatttttagaattacttttgatttttaaaactgttgcatttgaatactgtttattccgatgatggagtttcttggtgcccc

SEQ ID NO: 259207 - DNA, 410 bp, Homo sapiens
  misc_feature (76)..(76): n is a, c, g, or t
  misc_feature (108)..(108): n is a, c, g, or t
  misc_feature (117)..(117): n is a, c, g, or t
  misc_feature (257)..(257): n is a, c, g, or t
  misc_feature (376)..(376): n is a, c, g, or t
tgacaccacccctggcccacgatgaatagaggtgcaagagaagagtccagcctcttttttttttttgagtcccctntgtcgcccaggctggagtgcagtggtgcaatnttggctcantgcaacctctgcctcccgggttcaagcaattctcctgcctcagcctcctgagtagctgggacttgcaccaccatgcctggctaatttttgtatttttttttagtaagagacagggtttcaccatgttggccaggctgttntggaactcctgacctcaggtgatccacctgccctggcctctcaaaagtgctgggattacaggcgtgagccacccaccccactctgttgtcaccatttcgtgtgcattattgctcctcangaggttgcagtcagatgtcagctggggctgcagt

SEQ ID NO: 259208 - DNA, 488 bp, Homo sapiens
tcacctgaggtcaggagttcgagaccagcgtggccaacatggtgaaaccccgtctctactaaaaatacaaaaattagccgggtgtggtggcgcacgcctgtaatcccagctactcggggggctgaggcaggagaatcgcttgaactctggagacagaggttgcagtgagccgacatagtgtcactgcactccagcctggcgacagagcgagactccgtctcaaaaaaaaaaaaaaaaaaaaaatcaaaaaggtagctatcttacaggccacattctttgatcataaggtatagaaactggaaataattcatggtaacatcaccaccacctcatgttttggaaattcataattacatttcagaaaactccagaatcaaagatgaaatgaaaattgaagttacaagttggaaatcaaggaaaaggagaataaccacttctacaacttaggggacccagagaaacttatattcaatgaaacttcgtaacct

SEQ ID NO: 259209 - DNA, 509 bp, Homo sapiens
taaggacaattaatgaaggtgaagaaatagtggtgacttgaagttggttggggtttataaacaaaatttgcaagtttgaagacagaaaccaagttcttattttgggatcatagattctcccttattttgataagatgtgagtggggataggaggtgataggatttagcaaagaaaactgaagcaaaaaagtgggaagaagatcagaatagtatgttttggaagccaagagatgagtttcaaggatgggaggttgacagagccttttgcagagaagttaaaagaatggagaaaaggccattgattttgaaaatagggtaccatgtagtgagttgagagaatagctttgacaatgaggtaagtaaggaacaaaggctttaggagattaaggaagtatgggggtaatgaaagaactggagaagcattggatagagactttttttttttttcccgcccctgagatacggtcccactccagcctgggaaacaagagcaaaaccactctcaaaaa

SEQ ID NO: 259210 - DNA, 352 bp, Homo sapiens
caaaaaaaaaaaaaaaaaagaaagaaagaaaagtgtggtattatgcatactaacaacagggaaaagtgaaccagctcccaactgaatcctactttgctaagttgtgtacatgttttctttattcatttccattcacttatgtacaagttaaatatatattttttaattcctgctgtatccgtcaggggactagcaggaaacagaatcaaacagggacgatttaagagaagttaagaagggactaggaggctggctgtggtggctcacgcctgtaatcccaacactttgggaggattgcttgagtccaggagtttgaggccagcttgggcaatatagcaagaccccatcacta

SEQ ID NO: 259211 - DNA, 297 bp, Homo sapiens
gaagaggatgcccagagtgtaaagaaggagatggggatgggcaacagggctccagagggctaccaggctgtgcgttcacaggtcggaggagcagaaaatgcgtccatcgcaacaagaagggggactactgtgagtggaaagcttgctcatggagagggagacattcactcctctcactgtcccctatccctgctgtcccaaggagagagcaccccagttatgtgattgagtgtagtattttttaaatgtcagtactggtttgatttttaactaagtaaaaatggaaaattaaacaaa

SEQ ID NO: 259212 - DNA, 649 bp, Homo sapiens
tttcctcccaccctgtgattccttttcaaaattgtttagctgttctggttcctttgcctgtccacataaattttagaatgctcttgtctagagctacaaaaacatcttgcttagattttgataggaattgtattatacctgtatatcaatctggggagaattgacatctttactgcattaagtcttccagtccacaggtatggcatgtctctccattgattgacaactctgatttcattcatcagtgctttgtagtttttgacacataagttgtgtacatgcgtttttagaattatacccaagcatttcctttcctggcctgtgccatctcgaataagagtggcaagagcagacatccttgccttgtcaccgccttaggggacacctttcagtcgctcactgtcgatgatgttggttgcaggtttctttctagatgctctttatcaagttaaggaggttatcctatattgctttttttctgagagattttattttgttcaattttgttaaatgcttttccagcattgattgatatgattatgtgatttttcttctttagcctgttaataatggacattacatggattggttttttgaatattgaacaagccttctattcctggaataaactccacttggccatggcaca

SEQ ID NO: 259213 - DNA, 530 bp, Homo sapiens
ccaactctgagtatacttagggaaacataatgtctcggagctaatttctggacactgaagatggaataataaattattttgcaagtaattgtgtttacaattctcagcttccagcaaaactgaagaagaacctaacctagttgccagttgaccataaaatttaattaggggcatataattcaaaaggaggtttaaaaattgagtgtcccatctattcctaactcgctgagaattttatcacaacaggatgttgaattttgtcaaatgtttattcttcatctatggatatgatcatatggttaagcttatttaatatgtcaatattgagaaatatattgatggatttttttaattgagtaaagttgctattcaaatctagttccatccccatctactcacttctgtgaatgaaaattctcagtgatacgtgtataagaattttaaaaatagcaatataattcatgctgaaacctgtatttttctattagtaagtagcattcaaattaagatacctgaacaaattggaaaaa

SEQ ID NO: 259214 - DNA, 433 bp, Homo sapiens
ttataggcgtgagccaaggtgcccagccctgagagaatgtttattaaagaaccgagtaaacacttttctgtgatggttttggatttgtatattgatttccaaaattccaggtattcttagtgggctcagtttattttctgttctgataatcttgaaacggaatcctactgttagggcagacaattgggatttggattaccttggtgtttatactttagtgcaaactacagaaatgaaaatgtagactctgtactcatcaaaagtaatgaatcttttctgaaattgactttttttttctttttttggaatggagtctcactctgttgcctaggttggagtgcagtggcctgatctcagctcactgcaacctctgcctcctgggtacaagcaattctcctgtttcaacatatcaagtagctgggattgccagcgc

SEQ ID NO: 259215 - DNA, 413 bp, Homo sapiens
aagacaagaataaagagaagatcctaaaagtattcaggaagaaaacaggtcatgtacaaaggatcaggaatcaaaatggtaagagactttacaaaagcaacgctggaagctagaagataatggaacaatgccttcaaaattctgaggaaacatgatttctatctagaattccatactcttaagtgtgagcgtcaagatgttttcagacaggaaagatgtggtggttttaaaacatgtccaataatcctttgatactcctaatttcaaatggtagagactaatactctttcttgaatacgggtaggatgggccaggcacggtggctcacgcctatactcccagcactttgggaggctgaggctggcggatcacttgaggtcacaagttcaagaccagcctggccaacatggtga

SEQ ID NO: 259216 - DNA, 182 bp, Homo sapiens
gcacagtaccaagtaaccattttagtaagtgttaggcattattagtaatattcatcttcattgtcataaatattgataatcattgtggttaatatttttctgccagagtgtgtcttgaagcagcttattctgcaattcttcttaaaactgccagagttctgtttcttttttttttttttgag

SEQ ID NO: 259217 - DNA, 1016 bp, Homo sapiens
ctccgtctcaaaaaaaataaaaataaaaaagaagtcattagagttggtttctggtgaggattctcttctgggctgccttcttgctgtgtcctcacctggcctttcctctgtgcactgacaaacagggagatctctgatgtcccttccccttctcattaagacacaagttttattggattagggccctacccttatgacctcatttaaccttgtttatctccttaaaggcactatctccaaatatagtcacattgagagttagggcttcaattgatgacttggatttgggggagtagacacaattcagtccttaacactgatgatgctaggggacttttgtttctttcaccaaagaggctctagtttttacatctactgagtacatttgatgattttatgtatgatttgatatattaactctatagaaattaatgatagatactccatagtaatgacgtatacccacttaggaatcagccaagtgaaattttttgtttttatatgacttaattccactttaatcctaaggtaataaatttaagcatttcacatgtgtgcagatttaaaactatgctaaattttttactatttgagtcctatcaggttcctttaagtgaaattggcttacttatagtacttatgaattaaatgtatttctgaaaagtgttacgctttaaaaactgaatttttcccatgcattgtgattctaagcgtacttagttcatcaccccctccttctacccttgtccaatttacattgtcttctatgcttaattaccttcctgttttttgttttatttagttacagactttgttggggtggggggagaaatgtgttggatttctttagatatcattgatatggcattgaagttagttttcttctgtgttttatgatttctgctttatatttatgatctttttcttcattgaggttaaacatgatttttaaatgggattattttattttgtaatgattaaattatatagtaaattgtgaggatatgtaggtttcc

SEQ ID NO: 259218 - DNA, 727 bp, Homo sapiens
ggagataaggttctggccttcaaacactattttcactgacaatttctctttccttgcttgaataatcccactagcaatctaaagaaagaacttttattccaaagaaacatactcataaagctgtgagttgttaaagagaacatgtgagtttctcatattcctaccttccactcctcctgtttgcccaccctttcctccaactccacattcaacttaggatagttttatttacacaatgaggtctgattgttttggggctttctttgtcatatatcatgccatttaatggtaagcaatacatttgtgactattcttttaggatgcatcagactttccctataaatctgaacagagtgagtggtatggaaaactagctgctagaattttgtttttgcgagtaaaaggcaacgtaacataaaaattaaacaaacatcttcctttccaatcactatctgcatgttacaaaccatgtagatttgtaactttgccaatacactatggtggaggaagggtgcctctgttccaagggcttcactccttggagatgtgttttcagaccgtggaacacagtggggtcaagtctatcagtatgaggcacagggacaatggggagactaatttaaaaagcataatgtgggcatcagacagaattgggtttaaatttctgtattttcctcaccagtcaaaaggcgttgcttggttcagtctgaacttcatttccctatct

SEQ ID NO: 259219 - DNA, 820 bp, Homo sapiens
gccggaccatggttgccgcccggggcctaggactggttgtgcctggtagaggctgtttaggattgcccgaggcgagatctgctcagctgcttttcgtctgtctttgaggtgtggggatgaaggccggggcagtccctgagagtgcatcgctgtaggtccagggtctcacggaattttgcagaacgttccagaggagactgaatgggatcctcttaatttctgtccccatttcggccttttcttttcttccaccatgtattacctttgctccgctcagagagatgtcctctaataacgccagcgacgcattgtgctcctagcagaggcacgcaccaacctcccgtgtgttcgcatagtcaaatacagtttgctcctttgcacatttagcgctgtgataaacaaggataagtttttgtaatataagtctaatcattacgaagagggaatggggctgctcccaaaccagaagagtttgcatcacactgctaatgacaattggtaaagattaaagagccctctgcattatagtggatacctagagctagagtattcgattaagcaaatcatgcggtgatatcgttgaatactttgaccctggacgtttagtgttctctgaagtttcatccccaaccaatgtgaccagtgcatctggtttcaattccaaggactgggtcagcaaaaatagtacctctcacaggcggaaggtactttggttgtaaaattagcggcagcccaagtttggaaaatgctactgcctttctgaggcacattcccctgctatgtatattggtcagaaaaccaagtcaaactagcttagacc

SEQ ID NO: 259220 - DNA, 438 bp, Homo sapiens
ggtgggaagaagtccccacacacttggtcacagcaatcttctatgttgatcgattgtctttgagtaagagaattaaaaaaaatgctttgagtttgagtttctcagacagctcttcagacaaacccccttgtgatattctgccagcacagccctccattcatgggggactgggcccctcacttctcccaaactcattactgcctcttaatcaccacaggctggtcctgttttctctgcctgtcctaatgcgagcatcaagacctagtcaagccttgccttctccatgaagcctccccctccattcttccggttagccctgctatcagtgcagttcttctggcacatcacagtgagcattgcgttagaagtggcctgtttcatatctgagtcttgacatctttaggtattagaactcaaggagtgttacttaatcatcca

SEQ ID NO: 259221 - DNA, 531 bp, Homo sapiens
tattttgcctggctattaatatttttaaaacttcataaagatagccattatttaagtactgcgtaatgatttcagccacatttttgccattgctgggtacaatattagcactgttaagccagcagtccttacgatggcagtacatctaatggtgtgggagagaccacaggacgcgttctctaatttggcactagctcacagtgaactggtgttacaaactcctctgttgacattcctttgacatatgaaatgaccatctgctcttaaattctacttctccagtcttgagggtttacttttcccagatcaagcatcttttactgtgcagtcccagtgaggtagtagctgtctgccgaaagggggcatttgtagttagcccaggctaaacaagtgctaaaaggaagtggatcttttcaatatcatgagccacgagtaggaaatttgattgagaggcatttgtgtcaagtggtacatttttgaacctcttggcaaagaaactgaagtttatttttttttaagtcttttattatg

SEQ ID NO: 259222 - DNA, 434 bp, Homo sapiens
tagggctctctctgttgctctcagctgcagccacgtgttgccccatggagactgggccaggagctgctggatcttactgtttctcaagagaagttgtgaaatctcctcattttaaactcttggcaattatttcatttttgtaaacattgggagagcaaacaaaacatgtcggtaggctgtatttagcccacaagctgccagtttgctatctatgttctaggctttctgtgcttgacttagcaaaatatttactaagcgcctgctgtacctgtagctcctcagtacctggtcatgtttactgttctgccacctcaggcgtgctggctcagtcatcctatcaggtactaaatcagtttagtgggcttgaaatggtgtttcaattcaaattaaaatgcaatttgcatttccctgattactgctgagattgaacattt

SEQ ID NO: 259223 - DNA, 352 bp, Homo sapiens
aaagaagccggagagcggtagaccagacatctagacctgaaaggctcgtgcggaggcagaggcgggatcttccggaggtgagaattgtttttttattgtagcagaatggggaggaattgaggggaaaacggagatagaacctgaaagagccccaaacgtgagaatctgtagctccccaagaataagatcttccagaaaaattagaccgaaaactaggcgtctgggaaccctgacatccttggaggagtagcatcatcatgaccctctgtgttccttttggcataaggacttgcttccattgtttgtttgttaaattgttgtgtttgtttaataaataaaaccttttcatgta

SEQ ID NO: 259224 - DNA, 186 bp, Homo sapiens
acttgtgactatctcatttaattcttcactcaactgcatcagtttggtactactattccccttatgttacataaaaggaatgctaggcacatacagtttgaattacttcccaatttcacacccctagaaggtggcagaactgcctggtcagtcctggagtaggaacagagcgcacaaaatacaaga

SEQ ID NO: 259225 - DNA, 160 bp, Homo sapiens
catgtcgcagcaaaaaatggcaagagccctggtggccacgtgtagaggaataaaccgcggcacctcctcagccattagcgggaaccaggaatggctccgtgtgccccacagagtgagggcagggttgtggagtcaaataaaaaaacaaggtaggccacgc

SEQ ID NO: 259226 - DNA, 675 bp, Homo sapiens
ctcacgaaggaactacaattggcagctcaaggtatattattgttttattcatagcagaaagttttacaatatgaattgtatttttcaattcaattcaatatgcattaaatctttattattttgttttttatttatttttgtagagacagggtctcactctgtcacccagactagagttcagtgatgagatcatagtccactacaacatgatactcctgggctcaagtgaacatcctgccccagcctcctgagtagctaggactacaagtgtgctccaccataccctgctagctttttaaaattttttgtagagacaggatcttgctatattgcccaggctggtctcaaactcctgagctgaagtgatccttctgcctcagcctccctaagtgctgggattacaggcatgagccactgtgcccagtcttgaatgtacttttaattacttataatagcatgtaattaaaaacaaacatgagtaaaacttaggaaacaggtgtgtaatatggaaatgaaggcaactggttaaaatagatgtttgtggcttttgacaaggaaaaagagtggccagatctagaaagaatgatggcaacagggttatggagggagacagaaaatgtaatgggaaaaaataatgcttacaaaagcaaacaaaaaagaagttagcattaaata

SEQ ID NO: 259227 - DNA, 381 bp, Homo sapiens
ctttttaacgaaacacaacattcacttctaacacagctcagaaaaatatatcgcttgaggagaaaatgttaacacgcttgctacattccaaactgtgaatctgtatgtgatgtgtttagcaccaaaaatcagcattggcacttatctgaaaaagagtaaatatattagttattgaaaattctactcctccattatcatttatttacgtggaatgtaaaattcctgggttataaaaatacaatttaaatgttaaatttaaccaatttgatatcttaggtgattccagtaaaatgtattatatttttcagtaggtatagaggaaaaaatgttactgtaataaagtagctttaaatagttataaagtgataattcatcccgaat

SEQ ID NO: 259228 - DNA, 248 bp, Homo sapiens
gtgtctttcggtggaagttcacttatagttttgtgagggaagaggagtgggaccatgggcctgaacccttctcaccctgcccctctagcccaaattttattttattttttcgttgtttcatgtagtttgtgtgttgctgtgtgacctttggtttcattctctgaatagatacaaataaaatattaagttttcttttccctttaccccttgaattaacttctaaaataaatgctttatttttcaacccg

SEQ ID NO: 259229 - DNA, 284 bp, Homo sapiens
gaattagggaggcttcaaggaggaggtggaacgagagcgatttggaagccctgggttttttaattccaaaagcaatgtttgtatgagaaagaaaattgcagtagaagcaaagagacttgaaacctaatcagaaaccatccttcctccggctcctccgaagcagccagtttattctgtgccttttcccttcttgaggtatacacatttttatgtagatttaatcagggcctgttttgtctgtttttctgttttcatggattattataaacctccttttctctaga

SEQ ID NO: 259230 - DNA, 564 bp, Homo sapiens
tggccttcgagcagcccagggagagtctctgcgtcctccagcccccgcttcccttcatgtcggaggtcctaagcccgcagcgaagtccgcaaagagctttccccgacgcctacgagaccggaagtgcctgggcccaggtggaggaaggacccgcgtggccgcctccgcgctctccctggggtccgtgccccttccggcgtttctcccgcgtccttcaccatggcaactcgggcgtcgggagcgtgggctgcgagccgagtgggtgggggagccgccgggctctatccgccagcccacgagaagtgacgaaggagcaccattgaaggagaattagacaaactggagtctactgagatgaggctgttgggaatggccctggtaccacatcctgagcagggatggccgatggaatggggagaagactcaggtggggcttgagtgtgtcctctgatgactgaagagccttgggagcaagcatccttcctgctactgtgtgtttgctggttccaatgatacataatttgtgcttttcgtaattaaagtattatcctgtaaaaaaaaaaa

SEQ ID NO: 259231 - DNA, 433 bp, Homo sapiens
tggccttcgagcagcccagggagagtctctgcgtcctccagcccccgcttcccttcatgtcggaggtcctaagcccgcagcgaagtccgcaaagagctttccccgacgcctacgagaccggaagtgcctgggcccaggtggaggaaggacccgcgtggccgcctccgcgctctccctggggagcaccattgaaggagaattagacaaactggagtctactgagatgaggctgttgggaatggccctggtaccacatcctgagcagggatggccgatggaatggggagaagactcaggtggggcttgagtgtgtcctctgatgactgaagagccttgggagcaagcatccttcctgctactgtgtgtttgctggttccaatgatacataatttgtgcttttcgtaattaaagtattatcctgtaaaaaaaaaaa

SEQ ID NO: 259232 - DNA, 358 bp, Homo sapiens
tgtcatgacctccatcatcagatggatgtaaacagcctctgcaacttaaggagggtgtggaggggcaacactgaagtcccctcctgtagcaacgatctggcacaacttctgcctcaagtctgcttttgttttttggtacattagataaatattgaagtctgtatatttctgtaaattatcatggtctttaacttttatttatttttcacctatcagtgtattggagcaatttcatatctgttgcatcagaccttggtgtttcgttgagttaaaagatatttgatttttaactttttctttcatttcctaatagagacagtgaatgttaaaggatatcaataaatttgattaaaactgc

SEQ ID NO: 259233 - DNA, 344 bp, Homo sapiens
catgaggtcaagagattgagaccatcctggccaacgtggtgaaaccccatctcaactaaaaatacaaaaattagctgggcatggtggcacgctcctgtaggcccagccatttgggaggctgaggcaggagaattgcttgaaccctggaggcggaggttgcagtgagctgagattgcaccactgcactccagcctggcgacagagcgagactccgtctcaaaaaaaaaaaaaaaagtgatctatttttatttagggaaatttgaaaatacagaaaaataatcagctactcaattctggctgctattaagtttcaaaatttcttgttgaaaagtacaggcccagga

SEQ ID NO: 259234 - DNA, 690 bp, Homo sapiens
taagaggaaggaaggggtcgtatagaaatcccaggaatctgggattctggcatttataaccaggaaagctgaatttgagtttagagtccactacaatatatttatttgattttgaataattacaaccttgatttgctccttggtaaggtagaaatagtaatatcttcctttccaacctcattgggaaaaaagagagaaaccaaaatttgtatctattatgtaccatatggttttattctgagaattgagagaaataacatattttaagtgtatgtaaatttttttttttttgagatggagtctcactctgttgcccaggctggagtgcagtggcgtgatcttggctcactgcgagctccacctcccgggttcacaccattctcctgcctcagcctcctgagtagctgggactgcaagcacctgccaccacgcccggctaattttttcgtatttttagtagagatggggtttcaccgtgttagctggtatggtctccatctcctgacctagtgatccacccgcctcagcctcctaaaatgctgggactacaggcgtgagccaccgtgcccggccaagtgtatgtaaattttaaaaatgcattgtaaactgtaaagtgaaccacaggataatcatgattttctccctgttcttcctgtcccccaggttgagcatgtggataactgagagatg

SEQ ID NO: 259235 - DNA, 577 bp, Homo sapiens
ccggcagtaagtacaggtgctggtatattggcagtgctaaaaagttgcatgggaactacaggaagtctaaaatgactcttaatcacttagctgtttctgggctacaggaaaaaggaaatgaatattactttgaaatcttactggaaaagtggctaaactggtttatgtaggtaagtttttgtaagcagacaaaaaatttctaagtgcagtcttctctgtataggaaagctaagtcagaattaggtaatattttgttgtttcaatagatactaatattttgaaaaatatagttacttgttattgagtatatcagaagttaattattatatcaatagttggttttttaagtaggctggtgatatttgcctcatggtaggtcactgtggcatttctgggtgttaggatgctgttactccttaaaccctgaaaaagtgaaaacattaaagattcctgtcaaatgggtactaacgattctcttctgtgtgtgagatatgttgctaggtatggcgtgttaaagtataaaacagaacatttatgtgtgtctatgtaataaaacataacatttggaaaagattat

SEQ ID NO: 259236 - DNA, 1636 bp, Homo sapiens
caatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagagaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacacctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcattctgcaattaatgttaaataaactgctttaattcattgaaaatggct

SEQ ID NO: 259237 - DNA, 1582 bp, Homo sapiens
caatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagagaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacacctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggaggaagatttctttgaatgttaattgcattttcagttttgctcatttcccaccccaatgttttgtctgcaacatcgcttacactggattctttctatttttattcctatcattaaatggtagtgctgtaaattctgcattctgcaattaatgttaaataaactgctttaattcattgaaaatggct

SEQ ID NO: 259238 - DNA, 638 bp, Homo sapiens
tgatgattaatcatgtttttctacttctttgttgagtaattgtgaatagtatctagtggttatgaatgatctgggctttagagattacagaagaaagtatttgcagaattagggttcaagctctcttgttctctcttttaaaggattgcctctatcattttgtagcagcagtggctgccccctagtcttctggttctttaatccaataagacagtaaagttttcataagagttttagctgcccatgttagtgatgactgtggcctgccttcaggctaaatgccttaaaaatgaaaaactctagtgctctgcccaccttccaattgttgattaccttccagtttctgctgttcttctctctccagcagttgttttttctactaccgttttatcatttgttttctggttgttttgtggccttccttccctccttcttgcttgcctgcttacgtgattttctcagtggtgtgtttcaatatcttgctttttcttgtttgtgtatctgttgtaggattttttatttgaggttgctatcaggtttgcaaataatataactcattattttaaactgatgacaatttaacactaatttcaaaaactaacagagaaaactaataaaaattctacaatttaacttca

SEQ ID NO: 259239 - DNA, 589 bp, Homo sapiens
attgttagaaggtcattgcaaaccgagtcatcaaatttctaggtcataataaagaagtaagcgaagcagttttcctttctagatccctgagaattaagttaactttggatttgctactccctattcaagctgagattttattgttacctggcaataaagcctgtttaatagctctcatctctttctttacttcttgtctaagcttctggtcttcgtagattcaacttaataagtctgttttctaacttctcctgtgttcattttttaacatagtaagtactcaggaaatgcttacttggaacaacatttatatttaatatgcactttaagcgcctcttggtgagtggagtacggcagtctcctatgaaacatgttgaatttagtattctcttcctatcaacaatgcaagcaataatcagtcgggttcttttgttcaagaaaatggcggatgagaatgatattcaagaaaataggcagggactggagaaagcacctatttgatagaattttttttttgtatgtatgattttggaactaggtcagcacagcagtgtttatgaaacattggtaagatgggaaaattctctta

SEQ ID NO: 259240 - DNA, 878 bp, Homo sapiens
caaatgtattagcataaattgctcaaaatatccttatctttttcatatctgtaggatttgagagctgtcccctttttaattcttgatatcagacatttgcaatttctctttttttcttgataagtcttgctagcggtttatcaatttttaaaatcttctttttattttaggagatagggtctttctatgttgcccagactagactccaacccctgggctcaagcaatcctcctgcatcggccacctgagtagctgggattacaggtatgtaccacagcacccagcttaattttgttaatctttttattttttgtttttaatttttttagagacagggttttgttccgttgcctagactggagtacagtggcctgatcattacacactgtgacctcaaactcctgggttcaaaccatcctcctgtctcagtctctcaagaagctgagactacaagcacaacccaccaccgctggctaatttttaaaattttttgtagagactggtcttattgtgttgctcaggctggtctcgaactcctcacctcaagtgatcctactgcctcagcctcccagaatgttggaattacaggcgtgagccaccatgcctggcccacattacctcttaagatgactcaaaagcgcttcaaacataattgtgcccaagacaagctcaaagtctttcctctcagacctgattcttttccagtgaacctacacatttattgtaggtttgagttaagaaaagtgccaacagtgcaacacataaataggcaaaggacatgatctgacagtccacagaaaaataagggctttcggtatgaaaaaatcctccacctcattcataagaagaaaaactaagttgtatctatacaatggaat

SEQ ID NO: 259241 - DNA, 362 bp, Homo sapiens
tgagcaagtgctcacgggtagaaagctcatgcagtgtctcccacacccagaggattcgaaaatgaccctggaggtgtaaaagctgtctctggagattaaacgactggaacacgtgtgagacttgaagacgaacaatgccagttagaaaccagttaggaaggattttccttccctttccccacaaaacagagaagcagttatatttctctctttagcaattctgtgtttctcaagtactattatttactggggaaaaatatctgtgtttaggagaattcactaatattcttagtggcaccgatcacatgaaacaattcataatttttgtcttagttcagtttaagttcctgctttcctggatt

SEQ ID NO: 259242 - DNA, 515 bp, Homo sapiens
atcacttcatctcttttactttaggttttctgggatggatcactgttgtcttgtcagtgagaaggataagaagcaaatcatttttagagggtgatagcattctcttaatgcctaaggcttgcttttggatttccttccatcttcagtattcctaggtttgcctgctgttgttcataaggaaaaaaagatttttttttttgaggcacttactcatactgcaacactacttctatcagttttgttctttcatcatggattataaagataaacatgacattaggaaacatttcaggcaaaatgctcaagtgtattttgtttaagtaaacttctaatatcatatcaacttgcaatttatcctttaaaaggggttttgagaggatgaagggcaaatggcacataaactttttccatgagcctcaaattctggctagtaatttttttaaaaaatagcttttacatttctttataaggggctataccaggttatgatgccaacagaagacatacatgctagg

SEQ ID NO: 259243 - DNA, 351 bp, Homo sapiens
agcccccggggagcagcagaagtgcgtgggaacagagttgaacaggatgtggacttggacctgagcctggccctgccgctccccaccccgagttcttgcctggatcggggcaggaaagggaggctccattctggcctgaggcctgggtgggcctcctgccctaaacacaaggattgggacctggctctgtgggctcatccagtcattcaacaaacacttattggccgggcacggtggctcccacctgtaatcctaatactctgggaagccaaggcgggcggatcacctgagctcaggaatttgagaccagcctggccaacatggcaaaacaccatctctactgaaaaaaaa

SEQ ID NO: 259244 - DNA, 412 bp, Homo sapiens
gattcaacaaaaagagtattatctaaacccagcgcattagtctgttctcacattgctataaaggactacctgaaactgggtaatttataaagaaaaaaggtttaattggctcacagttcttcagtctgtatgggtaggctggctggggaaggcctcaggaaactttcagtcatggtgcaaggcaaaagggaagcaggtatatctccacatgaagcaggagagagatagtgaagtgagaagtgctacacacttttaaacaatgagatcttgtgagaactcaatcactatcacaagaacagcaagggggaagtctgctcccatgatccattcacctcccacttccaacactgaaagattacagttcaacatgagatttgtgtggggacacagagccaaaccaaattacattacc

SEQ ID NO: 259245 - DNA, 340 bp, Homo sapiens
gggcaacatggcaacaagccacagtcactgtgggcgggcctgagtggggagtgcaggggttcctgtcctgtgtgtctgtctcacaggggagtcctgacctgaccctcacagcccctccacccagaccttcctgcatgttccacccagcccaccctcctgcacccaagagcacccagccctcccttctgctcatgcccctcccttctcaaatccctcccagcagtgcagctctgggctaggacacagcctagggaacgtgactgagaaagagccaagaaaacttgatcagtgatcaagttggtgtttaagtaagattttcaataaaaagtagaattgggta

SEQ ID NO: 259246 - DNA, 667 bp, Homo sapiens
ctgaagtatctggctttagggttttacactaatgaaatgattttagggttttacaccaatgaaatgatagacacacaaagtgtgggaagctgaagtctgccctaaaactgaaggaacagaaagtttcatttaggaatttaaaattcagaagagataagaagcagaaactttaaggctgtgtgaaagggctggaatctacaaatggaaatcaagggaatgaactaaaagtcaaggaattatcaatttaacataaaatacttccatgatataaaagattataaaaataaagatgatagaagcagtgatgtgttttttctctaatcttaagaaccaaaaagaaaagcagtgtatgtgttttctagtttccattcattcaccaaaacatagctactgtcctaccagttctagagaaacgaatagagcataccaatgtcacattttcaccacacagaaaagaaacgctgtgaactccaagatgtcttgatcatcttttacctgtatccatatttatcactgcactttatcatgagtgaggctgagagtctgaattatacttgtgtgtgcctttgtattcctccctttgataagttaattcaaatggggaaaggggactcctggctgactgattccattgtacggttcgagaaggcccaaaatccaacattct

SEQ ID NO: 259247 - DNA, 521 bp, Homo sapiens
ccacaaacccccatgacactagtttacctatgtaataaacctgcatatgtaccacaaaattaaaagttaaataaaagcatggtaacaaaataaaataaaaataaataagtaaataaaagaaaaaaatgaaatattgagaagtgattaattatcacaatgctcaataaataaatgttctgagaggccatgtgaattatatgtgttatatattacatttcataatacattcatatattaatacattaataaattcacacatatattatttcagatttacccagatttatgtgaactccaaactaattttttgtgtcatataatcatcatggcattaactgcctttcttgtttcaaagattatattattctttattgcccctagtagtctcttccccagtagagggccaactactcttctaagctcacatagatagacataataatttagatttaggtacatcaaatacagtaaacaacagaatagttctgaatttttcaaaaattttccatagtttctgattc

SEQ ID NO: 259248 - DNA, 323 bp, Homo sapiens
aataaaatctggaactgaagtttcactcccctcatggaacaaatgtatcaagacttggtcagaactgaaggccagaacactttcaaaagtgaaggggtacaagctcaggaatgttaggtgttaagatcccttaccatactttaccatatatggtcttgtttaaagttcttccaatcaagacctacccaccagcacttctgcataccagcctgctctctctaacccagaaaacttgccccagactccagaatggggagatggaattgagctttgtctcctgcctcctcgccgccaaccccacaataaaacctttttttttctta

SEQ ID NO: 259249 - DNA, 384 bp, Homo sapiens
tgagcctcagtttccccatctgtgaaactggagtcgtaacagacccttctatttaaagtggttttgaggcttcagtgatgcccggcccatgcttagccaagtgtggtggacagaacagtggtgctcaaaagatgttcatgtcctcatccccagaacctggaaatattttaatggccaaaggagctctgtgggtttgattaaattaaggatcttgagatggggagagtgccctggattatctggtgggcctcacgtaacccccagaggccttataagggaaagagggaggcaagagagctggaaccagagctgtgaagatgcaagcagagcctggagtgatgccagcgctttcagcagctttgaagacgaggaagggactgtgag

SEQ ID NO: 259250 - DNA, 899 bp, Homo sapiens
gtgaatctttaattatgactataaaagaaattgtgattggaaatagaatttttatgctagtggttatgatttcattgaaaataggaaatcttatttaagaactctggtcacaaaacctccccagatagtgacgtaaataagacccagtgtaacaactgtggcattgacatgtcagttcatgtagattgagtcacaatttgatttcgagaatggccatatcccattttgtcttactccatggtgttcctgagcacttggatacaaatagattctgtttcctaaaagtagccaaatctttgtagttcaagtgaatattccagactaaaatatgtgtctttttgaaggtccttaagccttacatacttaattgtgtaatttggcaaatatttgctgttgtgttgtgtcaagtcctgtgatagagacagttcctacctttctggagctttcacagtgtgactcatttcagtacgtaagtcggagccagttttaatagaatgttctctggttgacttctgttgtaaggaataatttcatttcatgtctgggtcaatatgtgaaagattaaattattagggcaaactgaaaaaaaaaatctagttttacccccccaccaccacattcccaaaataatttagcatggtttataacaaatatcaagcaacaataattagaagcagataaaagctcagcaagtagagggcaagaataaaaaacctaactgttagatctcatgctgtaggctccagccaagttgtctctgagcttcctaagagcaaagagccaactggcaagttagtaatcaggcaattgccataattttctaatggaggaggggagtggtcatgtgcattctaagctctttaaagccgaggagtaagctttctttccttcatgatctc

SEQ ID NO: 259251 - DNA, 449 bp, Homo sapiens
agacagatcatccgttctgagtagggcttaattggacaaactaaagctttggaggccaaattccctgtctcaaaaatgaattgcagaaatcagtctgtgactggctaacagtttgtggataacatagttcaaaggtatgtgaaagggcttcagatacgctgcttcctgacccagcacagtaaggatcatttacgtgccttcacttacaagatcttgccctgtcactaaaaagcttctagatagagctagctatatacaactctctcaaagaacagcagctaagagcatttgataaatgcttagaaaaacttagcttacattttcttttcagccagctggagcctattggcttttgaaattaacaggaaggaacaggcactggaaggagcttcataaaccatcaacccagtcttatctccatagcaacatggttttctcacatctgaata

SEQ ID NO: 259252 - DNA, 2138 bp, Homo sapiens
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgtacagaaatctattttataataatttatttttaattcataagcaattaattcactaagctgcctagccacactctttagagagttagcttcataatctgttaacattccaaagtgtttaactctagtatttcgttttcttcttcacaattgatggtgcttctattttttcttctcccctacctgttatatttaaaacaaagaaaagcacaacttgagatttttgttgttacgggtattcagccttcagtcaccgtctgagttctccagttgctgcctccttgtcttgtcttgggtctcccattccagcttccctgtctcttcctgcctgtgtacctcgtaggaacgctgagctgcctcaacagggctgtattctgaagggcaggcctcatgcagcagcctccttgcagatgtggtgtcccgtccaatgatgtagcctgaaagccacagccctagggttctg

SEQ ID NO: 259253 - DNA, 2808 bp, Homo sapiens
agttcgcctctgcagcctctgcggggaagtgccggggctgctcgaggctcagttcttaggactgcaaggaggcagccccggcgtgcggcggtgcgcacagtctagagtggccagggcgcgagagtgcaacgtcctcctggccccgagcgcgtcgtcgcgccccgggagcagaccctcgcccagcagttaccgccgtcccgactttccgttccagttgcagctcctgccgggcaacatgtcaagagccgccgccgctacagctgccgccgccacctggggaagagcagcagcagcagcggcggccgcgggcacacgggggcaataaaccgagccacccgggcgtccagcgtgccggggaaccctctctgcgctcactgcccggcgggacccacgccatgtgctgagccatgtccctggccgcgcccgcgggcagcgcatggggcagcgcctgagtggcggcagatcttgcctcgatgtccccggccggctcctaccgcagccgccgccgcccccgccgccggtgaggaggaagctcgcgctgctcttcgccatgctctgcgtctggctctatatgttcctgtactcgtgcgccggctcctgcgccgccgcgccggggctgctgctcctgggctctgggtcccgcgccgcacacgacccgccagccctggccacagctccggacgggacgccccccaggctgccgttccgggcgccgccagccaccccactggcttcaggcaaggagatggccgagggcgctgcgagcccggaggagcagagtcccgaggtgccggactccccaagccccatctccagctttttcagtgggtctgggagcaagcagctgccgcaggccatcatcatcggcgtgaagaagggcggcacgcgggcgctgctggagtttctgcgcgtgcaccccgacgtgcgcgccgtgggcgccgagccccatttcttcgatcgcagctacgacaagggcctcgcttggtaccgggacctgatgcccagaaccctggacgggcagatcaccatggagaagacgcccagttacttcgtcacgcgggaggcccccgcgcgcatctcggccatgtccaaggacaccaagctcatcgtggtggtgcgggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctagtgtgacttttcagcttatcaagaggatggccaataaaacttaaaggtgtggttag

SEQ ID NO: 259254 - DNA, 713 bp, Homo sapiens
gcaagactcagggagtatcctgccctgttcacaggggcagagctggatttgagcccaggtcttagaagacagaggccgtggccttttccctatgcctttctgcctcctggacctgtggagcagagatgttcactcatgcctgggccattctgtgcaccagtgcccctctcttcagggaagatattcaatcagagtgtgtagccccagtaattctggcattgggtgcaaggttgcacaagatgacttttaagaccccatccaaacgtcagctcctattcttccaattcaaacaggagtaaatgaacagatcgcagtttaagagcttcatggtgtctttatattcttcctgccgctctgtgccaatcagcatgtctgttctttcaggactgcatgataaccttcttgaaagacatctcatattccactccaactccaaaaattttagtagctcccatttgcctatggaataaacaaaataatatggaatgaatgaagaaacaaacaaacaataaagacacattttccttttcaaaacttgtcatattattttgagcccatgttagccccctttgtagagtctttccttctgggaaacccgtcttcttacatttccatgctctgtcttctgtaaccaggctgttctctctggctaaaatgtgctcctccctgacagccctactttaatactttccctcttctaagggtcacctcta

SEQ ID NO: 259255 - DNA, 316 bp, Homo sapiens
caactttaggcctaaagtgactccccactctgtcagtcaaggaatttggtacttctcagccttctcccactcaatttctcttccttctcatttctcaccctccctcagccatcagtttttttacatcaacataccttatatcatctacatttcattctgtgactgaatgtgttatgtactctgactataggttggttacaaaaattgaaaaccagtaaacaaggatacggaattttaggtaggaggaataagttcaagagatctattgtacaacatactgattataattaataataaagcatgtagttttgaaaat

SEQ ID NO: 259256 - DNA, 660 bp, Homo sapiens
ctctctgtacgtttatcttttcagtcttccttcgattctctctgtaagatgtgccctacttgtttttgaacactggtctctccccgttctcttgttcgcacttgtctttacttcctcctcaatcaatgtgttgttccatttgcttttcaagttcaatattttgaaatactctaccagcatgtggtttgttaaaactccctttggttgtttatattgctccataactttgtttaaaggctacatttctttattaagttgatcaaggtggaaaaaagaactatctatggttttgagtgaaatgcctatgaacctattctaaatagttcagttttacaacttcaagaatgcattttcccagtgaatttaaccatactaaatatccagtatccaatgacaacttacaacactgagaagacgtaatactgacacatttgttaaaaagtaagttgtgtgtctgtatgtgtgagtttatgtgtatccaagagtttatgtgtatgtttgtgcataagtgtatttcttgtgtagtagctcttaatgtatttttaactgagcaagttcctgcaacattacctctttttgtaaagcttcccagagttggtttggcaatgcaaacctatttactgagaggaattggattcagacatcattttcatttaagga

SEQ ID NO: 259257 - DNA, 464 bp, Homo sapiens
aagtcgtatcagggctcattctgcaactattaaggttctttattaataacttaagtcttaaatcattaaataacatcttaagttctttatttgttgaagtaatttaaaggtattatgagacaggagaaattaagttccaatgtagttcatattttttccagagatttgtttgattatttttaggtactcaaatgtaaaattgaatttactcctgaatatctctggggagcctcactttgtaagtggaatggcctaatattttttagtacctgtctggctgttttggtcggtaagattaactttgcctgtttttctgagtcagtggttaaattatattttagtattttctctatcagcagacaattttattattacagagtaatatttaagattacagagtaaggtttaagttggaaatcactgagaagttggaagctgtcatggaatgagtttttcctcatcta

SEQ ID NO: 259258 - DNA, 215 bp, Homo sapiens
aatcatatcaactaatcagccatctattcatcatttaacatgacagaactgaggaaaaatcctttaggagaataaaaaaattacaaaatcccgacggactctaagtctagttactccttttcatatgttttaaatgcttgtcactggaaatttatctgatggtccagacttttagcacagaaactctgggatagtttacaaagaaaacctggaaa

SEQ ID NO: 259259 - DNA, 473 bp, Homo sapiens
ccagcaagttaataccagcatcctgccggttcagtgcggggcgcaagccagccctcctcacagccccttggagcctggaagaagcgaccctctgctgttggaggatggcctgggacacggaggccccagcactcgccaggcttcatgtgcgtggggacccctgtgtgccatccagcgcccatgatggcagcaggaccagggagtgcctgggcacaacggggagctggcaccaactcaggcgagggtgccgggggccctgggtcactagagacccctgcccatcagagctccctgacgggtgacagggaggggctcccactgcctacaagggagcaaaaagggactctgggggagggtgggcggcagagtacaatgacctgttgtgtgtgcactcacatcgacaggtgaatgcggatcacgctggtccctgtctggggttctcttccccagactttctctttctgaaggggagg

SEQ ID NO: 259260 - DNA, 341 bp, Homo sapiens
tacggcacgagggtcattgacaagtccacatgcacagcagcacgagtggttaactcaccaagaaactggccttggtgaaattcagtaggccggtaacagatgcccaccgtgggccagccctagcaagcagggcctgagttttagaaactctggtagtggggagttttagaaactctggtagtggagctaacactaagatttgaatttatttattcaacaatttttttataccaaatccttgccgtttgcttcagatgaaaaaaggggaaagaaatcctgtgaaactggtagtagtcctcatgcctaaaaagggacttcatgagttttaggtaacctctcaa

SEQ ID NO: 259261 - DNA, 728 bp, Homo sapiens
gatgagaaaacagaggctcagagatgttaacaggcacagagctggcaagtgaaagcacaaggattcaaacccagatgcagtggagaccaaggtgtgctactgctgactagccccaccgtctgtccgtaccatgctggacaaccagggcactccagaaagccttcttcatgggcttctgggctcccagggatgagctgggggtgggttgccttttgtgcccctcactgaattgagagaacccccctctgctcctttgccttcggtgccctaggctggaccctttcctgtttaagcaacagagcagtgggagcggccctgctgtgcaagcctctcgagcacagtctgcattcagtcatttgtcatggaaacagtgtgggaacggaacaggtgatgagcccttccatcaaaggtgtattcagtacctactgtggcctccagatgcagaaagtcaaagtagtgcctgccttcggatcccccagccccgtggaggaaacatagaacacctcatggcagtgagctgagaggactcaggaggagtgaggggctgaaaggccagggcagggacgggctgagctgctgcttagagggtgtccccgtgttgctactgccctcctagctcctctccactcctttgctttggtccccagctaagggccagagtgcacttctatcaacttagaatataacaataatcattaaacaccatgtggtggcctgagaaggagtct

SEQ ID NO: 259262 - DNA, 647 bp, Homo sapiens
actctatctcaaaaaaaaaagaatgatctcagatagatactgaattcttattttaaaaataggcagtaataggaacaaaatagctaaagtgcagacaaccactagagaaaacacaattgtagcatttgggttatgtagagagattacctgcattaggtctgcattcagtataagaagactgttgtagatgcatttatttggttagattcaagtttggtgttgataaataatgcagtgaaattatgttatattctaggcagatagataatgaataattattatactagggcttttgccctttgcaaggcagaaagaaagtgatagaagtataaaatgtgattcttgccattaagaattgtcatagtctcatgaagtaatagtgatcactacaagaaagtatctagtcctgagttatttagtgcatggactgtaagtgttcagcagagaaaactggtcaagacagatgtagtacatctccattgttaatggaggaaatgagacttaaacttggtcttaaaatgtgggtaggatttagaaaggagaaaggataaatatatttcaggagcaccatgaggtaagcatgttcttggaatagtggtgatggctagcttgactagagttagaaggttcacactgattaggaatga

SEQ ID NO: 259263 - DNA, 1760 bp, Homo sapiens
caggctgcgggcggctgcagacctgggagcggagatccgcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagtgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatcatacatgtaacaattctgatctttttaaggttcactggtgtattaaccaaacgttgtcacaaattacaaatcaatgctgtaatataatttgcacctggaatggctaacgtgaagcctgaattaaatgtggtttttagtttttaccatcacc

SEQ ID NO: 259264 - DNA, 2092 bp, Homo sapiens
caggctgcgggcggctgcagacctgggagcggagatccgcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtttccctgtggtctctgctagtgactctggtggtccttttcataatgaccggcactatgttaggacctgaactgctggcaagtatccctgcagctgtttatgtgatagcaatttttatgcctttggcaggctacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagtgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatcatacatgtaacaattctgatctttttaaggttcactggtgtattaaccaaacgttgtcacaaattacaaatcaatgctgtaatataatttgcacctggaatggctaacgtgaagcctgaattaaatgtggtttttagtttttaccatcaccaatttctatgactgttgcaaatacagaatctattagaaaacagggtcttggaaatgtagaattttggcgcactatgaggaaaaacaagctatctttgtaaagcataattgagtttaatgtaattgttgtaaaaaaaaaagtgtgcttgctctacttaaaattcctcacaatgttgaattttgacctgtattcagaagaattccaaaacaggtcagttaaataaggaaatatagtatttgtcaaaccagtatcagagaaaagttacattaatgtatttgattacttgatctggtatctacttattaatgaataatcaacatttttctagtgaa

SEQ ID NO: 259265 - DNA, 499 bp, Homo sapiens
tagtttgggtttcctgacagcatcgtggctgtgtttcaaggatgagtattttgtgaaagaaaggaccagacagaagttgaatcatctcagaagtcatgctgtaatacttccacctcattctgttcaacaaggcaatcacaaagtcctgcccaagtttaagggggtggggacatagacccccctacaacctctccatggaggaaggagtgtcagtgtcatattgaaagaaaggcatattggatgagacatatgttggtatagtcatctttggaaaatataatctgcaacaatcttccatcaaattataaatccttgacaaaatcctatttgaatagccaggtccaatgaaaatgtcacaactgctataaaatctttctgcatgctaaactagtttctcctttcactatgttcccagaagactttgcccatttccccattatacagtttataattttgtatcataattatttaataaatatttattttaaaattatataag

SEQ ID NO: 259266 - DNA, 520 bp, Homo sapiens
atttttcattttgtcagactgcattttctcttttcaactagagttcaaacaaaataattttagataacatcctaagaacatttggaaacatgacatttcaggtctattttccctctttgccttaaaaaagtatatacagctataattactaattgctgcgctctaagtagagacagatgatacatatgtttgtgacaattttccagagggagagctaagtaaccaggctcatttttccataatgtgaatgttattcacaaactattaccataattgatgcaccaaaccactgtagagtaaataatgtgttgtgtgtgggaagcaagctagtagtcaatgaatattaaagaacaaaacctcattttaaaagagaaactgtaattaaaatcattctgaattcatgctgcacaaccagttaaaataacttggctgccatttatctgtgtaattctgtgtataaagggagtaggtatatgatttgttatatagaagtaagtatttacatgcacatttttatgaa

SEQ ID NO: 259267 - DNA, 411 bp, Homo sapiens
  misc_feature (411)..(411): n is a, c, g, or t
gcagctagggtcacaatctgagggggcctcctctctgcccccctggaagactctgctcttggcccctggagagttccagctctcaggggttgggccctgaaagtccaacatctgccacttaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtggagacatgn

SEQ ID NO: 259268 - DNA, 1543 bp, Homo sapiens
  misc_feature (1543)..(1543): n is a, c, g, or t
acagttagcctcgagaacctttgctttcagccggactccggactcctccggggacagcgcagcgcccgccagagccctcggcgctccctcccgctggcggcctccgcagccttcgagtgggtcctccgcccccggccctcccctctcaggcggagccaaactgcggccccgcctttacagtctcggaaaggtccccagactggaggctctgaggaaggggtgtggggagtcgggggcggagacttggggcggggggcgggcaataaactcccaggccccgcccacgccccgccggggccctaatcctggacccgggatcccgtgcgcctggagacagggtccagatctgcctcgagcccctcgaaaccaggactccagcacctctggtcccgccctcacccggacccctggccctcacgtctcctccagggatggcgctggcggctttgatgatcgccctcggcagcctcggcctccacacctggcaggcccaggctgttcccaccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggggactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtggagacatgn

SEQ ID NO: 259269 - DNA, 1230 bp, Homo sapiens
  misc_feature (1230)..(1230): n is a, c, g, or t
acagttagcctcgagaacctttgctttcagccggactccggactcctccggggacagcgcagcgcccgccagagccctcggcgctccctcccgctggcggcctccgcagccttcgaggatggcgctggcggctttgatgatcgccctcggcagcctcggcctccacacctggcaggcccaggctgttcccaccatcctgcccctgggcctggctccagacacctttgacgatacctatgtgggttgtgcagaggagatggaggagaaggcagcccccctgctaaaggaggaaatggcccaccatgccctgctgcgggaatcctgggaggcagcccaggagacctgggaggacaagcgtcgagggcttaccttgccccctggcttcaaagcccagaatggaatagccattatggtctacaccaactcatcgaacaccttgtactgggagttgaatcaggccgtgcggacgggcggaggctcccgggagctctacatgaggcactttcccttcaaggccctgcatttctacctgatccgggccctgcagctgctgcgaggcagtgggggctgcagcaggggacctggggaggtggtgttccgaggtgtgggcagccttcgctttgaacccaagaggctgggggactctgtccgcttgggccagtttgcctccagctccctggataaggcagtggcccacagatttggtaatgccaccctcttctctctaacaacttgctttggggcccctatacaggccttctctgtctttcccaaggagcgcgaggtgctgattcccccccatgaagtctttttggttaccagattctctcaggatggagcccagagcttggtgactctctggagctataatcagacctgtagccattttaactgcgcctatctgggtggggagaagaggcggggctgtgtgtctgcgccaggagccctgggaacgggtgaccttcatatgacgaagaggcacctccagcagccttgagaagcaagaacatggttccggacccagccctagcagccttctccccaaccaggatgttggcctggggaggccacagcagggctgagggaactctgctatgtgatggggacttcctgggacaagcaaggaaagtactgaggcagccacttgattgaacggtgttgcaatgtggagacatggagttttattgaggtagctacgtgattaaatggtattgcagtgtggagacatgn

SEQ ID NO: 259270 - DNA, 318 bp, Homo sapiens
tgtgcaccttccacattctgatttatgtcttggcctgtaacttgtgtcttcctgaaatgagtaaaaccaaactgtaacccggccgcctcggggccactcagtcaagctgtaacccggccgcctcggggccactcagtcaagctgtaacccggccgcctcggggccactcactcaggctgtaacccggccgcctcggggccactcagtcaagctgtaacccggccgcctcggggcgactcactcaaggcttcctgggtttgcttctctccaggccacagtcacatgtacaggctcagaataaacctctgtaaaatgttc

SEQ ID NO: 259271 - DNA, 387 bp, Homo sapiens
atcgcaggcccagcctgttgttatttaaaacaaaaaatgtctaatagtgagggcatttcgccaagttgcctaggctgatcatgaatcctgaactcaggccatcctcccaccttggccttctaaaatgttgggattatgggtgtgagccccggctagcatgaattttctaagtcagaccaaagaactgttgacaggtaattttttgttgaaggaggctgttctgtgcattgttggatttttagcagcgtccctgacctcagtccaatagatgccagtaacaactccctcccgattatgatcaccaaaaatgtctccagacatcgccaagtgttccaaaggtcacttctctgatatcattttatttaactttccaacatttgggaaaaa

SEQ ID NO: 259272 - DNA, 918 bp, Homo sapiens
caaaatgattagttaattatccataaatgttccttttgaaactgaccaagaaggccccccatccccgtaaactgattcgaactttggagaaggaaaggccgaaagatagtagctagccctacaattttggatatcttaatttctaaaacaggttttctagaacttgctttctgtctttatgttcatacttaaagaagttataggtgtttttaatatatatcctaagtgaggactgaagctttgaattacattaaaaattaatccgtcttatttttgtaagtttggaattcttaagacttaatctgttcaatgcaaaatacaggctggacatccctaatctgaaatccaaaactttttgagtgccaacatgacactacaagtggaaaatccacacctgatctcgtgacaggtgtgcaaaattaattaaaatactgtataaaatcacctttaggctatgggtttaagaaggtgtataggaaacataagtgaattttgtgtttagacttcagtgccatctccaagatacttcaaatatgtatgtgcaggtactccaaagtccaaaacacttcggtcccaagcattttgaataagggatactcaacatgtgccagaaaatgtttgggcatgctatagaaaccattttcttctagcaaagttactcatcccagtgaactcacaggtatttatctaaagtaaacatggggaaggataatttacttcccaccctatgtgcagctcattacgtcaaaatagagaagtgctgttatctcagatgtggctctagaaatttaattttttaagctgatctttaagtgttggtgttctgcagagtgcttactgctaaagtgaacagaattcatgaggcaattagaatttgaaaatagtgatttagaagacagtgcaattcatgatttacct

SEQ ID NO: 259273 - DNA, 865 bp, Homo sapiens
caaaatgattagttaattatccataaatgttccttttgaaactgaccaagaaggccccccatccccgtaaactgattcgaactttggagaaggaaaggccgaaagatagtagctagccctacaattttggatatcttaatttctaaaacaggttttctagaacttgctttctgtctttatgttcatacttaaagaagttataggtgtttttaatatatatcctaagtgaggactgaagctttgaattacattaaaaattaatccgtcttatttttgtaagtttggaattcttaagacttaatctgttcaatgcaaaatacaggctggacatccctaatctgaaatccaaaactttttgagtgccaacatgacactacaagtggaaaatccacacctgatctcgtgacaggtgtgcaaaattaattaaaatacttgaattttgtgtttagacttcagtgccatctccaagatacttcaaatatgtatgtgcaggtactccaaagtccaaaacacttcggtcccaagcattttgaataagggatactcaacatgtgccagaaaatgtttgggcatgctatagaaaccattttcttctagcaaagttactcatcccagtgaactcacaggtatttatctaaagtaaacatggggaaggataatttacttcccaccctatgtgcagctcattacgtcaaaatagagaagtgctgttatctcagatgtggctctagaaatttaattttttaagctgatctttaagtgttggtgttctgcagagtgcttactgctaaagtgaacagaattcatgaggcaattagaatttgaaaatagtgatttagaagacagtgcaattcatgatttacct

SEQ ID NO: 259274 - DNA, 492 bp, Homo sapiens
caccgaaccaccatggcacaccacatacttatgtaacaaacctgtacgttctgcatacgtatcctacccagaacttaaagaaaaaaaaaagcctccaaatcttaactcttagaaaaggaagacagattgctgggagggaactcacagcaggaatacgatccaggtggagaaaagccaggtaaggaacctcctcaatggtccagcaacacacagatccaatgaaaagctagaaatgcaagagtggctacagattaggaatactaatgccagacaaagagtttccacaattagcaaaatacctctgatgcagggtgaaggctgctccaacccagtcctgcacagcccagaagagagaatcagaacctggctctggagtatagtccctagaccaggagcagcagcacctgcaagcttgttagaaatgcagaatctctaacctcagaaccaatgaattaaaaaaaaaaatccccagtgttctacatgcacattaaa

SEQ ID NO: 259275 - DNA, 627 bp, Homo sapiens
tttttgtttttaacacaagatatgccactaatgtctgacaagcatttaatctagtggctttcctgcattttccatggatcagatgcattctaatcctctgaaatgattattaaatacagattgccagcctttatataatgcctgctaaatttaccagttgggatctgcacatatattggtaaagagtgccctagcagtttctgaccttctgtctgctttcagaatccacatgagtcaaattatctccttttatgtataatcttatcaaggactattgaggtggcacaggtggggatggaatcctggatgtgttcagaactcctttcattttactaagcttcctttatactaccagaggaatccacttccagtctcgagtcacttagaagagggggccgggcgtgatggctcatgcctgtaatcccagcactttgagaggtcaggagatcaacaccatcctggccaacatggtgaaaccctgtctctactaaaaatgcaaaaattagctgggtgtggtggcatgcgcctgtaatcaggaggctgaggcaggagaatggcttgaacctggtaggtggagattgcagtgagccgagttcacactactacactccagcctggcgacagaaa

SEQ ID NO: 259276 - DNA, 501 bp, Homo sapiens
atacagaagcaatatcttccatgaaacatttcctacctctaggctgacatgttttcctctgctgagcctcttagtaaccattccttctttccacttcatgaccaatttcttgaaatcagggattgtgtatttctcaatttgttactttaccccaaagtctatcatgttgcctggtattcaacagacatcaaaaaatgtttgctgtaagatgggcagtgtggctcatacctgtaatcccagccttttggaaagccaagaaaggcggatcactgagctcaggagtctgaaaccagcctagccaacatggcaaaaccgcgtctctacaataaaagaaaaaaacaaatacaaaaagttatccgggcttggcaacgcaagcctgtagtctcagctacttgagaagcagaggtgacaggatgatctgagcccaagaggtcgaggctgcaacgagctgagatagcgccactgcaccccagcctgggcaacagagaccctgtctcaccc

SEQ ID NO: 259277 - DNA, 244 bp, Homo sapiens
tgccagcctgctccatttcaggccaatgtttatgctaaataagatcatgaggatgtttatctcataggactgggagctgggaattggttccacaccagttgtggcagcggaagggatcactcagtgattgaagttacttttggaaaggtctagaaagatcgcagctcagtcgttttcttatctagacatagcacacatagcctcaggaaggtgagccccaaaccacaccgactcccctgagaaa

SEQ ID NO: 259278 - DNA, 448 bp, Homo sapiens
ttgtttaacatatttaaatgcctactttgcactaggtgctaggatatactagggaaggagacagacatggaccttgccctcacacagcttacatgtcattactactattaaacacaccagctccctaagaaaaataagactgcacttaactaggaatatagacatgtttaccttgaagctcagtgcctgtcatggtaggagcttgataatgcatggtaaacattcccttcagagggattcttcatagcctgagatggctgaggttgcttaaaatggaagcccactaatttttttttctttctaacttttattttaggttcaaggggtacatgtgcagatttgtgatatgggtaaattgtgtgccacaggggtttggtgtacaaatagttttgtcacccatgtaatcaggataatacccaataggtagttttttagtcctcaccccctg

SEQ ID NO: 259279 - DNA, 425 bp, Homo sapiens
ttttttttttcgagacaaggtcttgctctgtgacccaggctggagtgcagtggtgcgattacggctgactggctgactggctgactggctgactggctgactgcaacctgcaccttctcctccacctcctaggttgaatcctctcacctcagcctcccaagtagctggaattccaggactgtaccactatgcacggctaattttttttttcttttttgagacagggtctcactatgttgcccagggtggtctttaactactgagctcaagccatctgcccaccttgcctctgaaagtgctggaattacacatggccaactatttttttaaacatggttattaggaaatatgttacttgtatgtgaaataagcaagtatatgaaatgatctcattatttttagacaaattattttcttaaggagat

SEQ ID NO: 259280 - DNA, 194 bp, Homo sapiens
gcagagatcaaatggcaaaagaagaaacaagagagaggggctaggctctgtttaacaaccaggtcttctgggaaggaatagagtgggaactaactcattgctccctgccctcacaaacagggagagcattaatctattcatgatctaaccccatgacccacatatctcccactaggccccacctccaacattgg

SEQ ID NO: 259281 - DNA, 233 bp, Homo sapiens
aaaagaacggcatcggaccctcacctcacatccacaaaaacccactcaacatgggctaaagactgagacataagactggaaaccataaacgtactagaagaaaacacgggggaagcatgatgacattcatctaggcaaaggtttcttggatctgacaccaaaggcacaagcaacagaagcaaatgtgaacatgcaggacaacatcaaaccagtgagctcctgcatcagcaggg

SEQ ID NO: 259282 - DNA, 821 bp, Homo sapiens
agaaattctcctgccttagcctcctgagtagctgcaataacaaagcgtgcgccaccacatctggctaatttttatatttttagtaccgatgggatttcaccacggtgaccaggctggtctcttaactcctgagctcatgcgatccttcctgttaggcctcccaaagtgctggaatttcaggcatgatcctccgcacccggccctcttttttttttttattttgagatggagttttgctctgtcgcccaaccgggaggtgcaggttgcagtgagccaagatcacaccactgcactccagcctgggcagcagagtgagaccgtgtcccaaaaaagagaaggagaaacagagatcatgtggaaaaagttattttttatttatttacttagttttcagtttggtttgagactcgtgttttaaaccagagggcatggttactgagggataacatcaatagaactcctataattgaggggataattatcaaggtattagatgattcactggctattacaaagaacacagaaattatgaaacctggttctgtaacttatagtttttcatattatttttataccatggataactcttctatgtgtattcataggtgtaagattactggcagtgtcatatgaaacaacatattacattttttaagcctggaaagcatctagtatggctgtgcacgtagtgatgacattgactttttttacttaaagaagagctaccacttcaaatccacacggtggcagttctcctgcctagccagctgccactggactctctcccctgtatataagcccccaataactacgtcttattt

SEQ ID NO: 259283 - DNA, 437 bp, Homo sapiens
cctccttcccctcatccagcccctccaggacaattctgaagctgcctgaatggaaaaaaaacagagaaaaccctaaaagtcatctcagaatgatggtacctgccccctccccaggctcctcccttgaaaccggcaattcttacagcctacacagatggcacatgacctgcaatctcttctgttgactgtgtacattggttggcctttattgagcacctgccgtatgcagaggctaccagccatccatgcccttgggcagtgggaatgccagcctgttacagtgatttcatttccatgagctcatcccaaactttcaattctgccatatccttttcaaactgtccctgatccttcccatcccactcctggcaagtccggctcctgtgacagggacactgagagcctaagcaaatgatagagagagagagagaaaaaaa

SEQ ID NO: 259284 - DNA, 449 bp, Homo sapiens
agccctagctgctgcgctggccgaagttttctcgtcggtaaaataggataacagtgcaccatagggtcgttttgataaagaagaaaggtagggcacttaacacagttcctggtaaagagagttcaaatgaaagtgaaggaggccgggcgcggtggctctcacctgcagtcccaagcactctgggaggcctgtaaggtgcctgtaatcccagctcctcgggatgctgaggcaggagaatcgcttgaacccgagaagtgaaggttgcagtgatccgagatcgcaccactgcactccatcctgggcgacagagcgagaccctgtctcgaaaaaaaagttaaggtttttttgggggaaagaggtgaaaacgtatttaaatgttctttcgagcctttaaaaatgtgtatagttgaaaatactaaaattgaaagtgttaatttcttttacagttt

SEQ ID NO: 259285 - DNA, 432 bp, Homo sapiens
atcagaacagggtggtttcctaatttttagattgctggccttttctagaaaataaaggcaaggtgtgcatacttgaggtttgagggctaccattgcctcctggcagaggaaatgagtaggcctgatagttgctaggttaaaaagaaacagtagttgaaatactgagaaaagtttaatgaaaagtaactttggctcttaagtagaacagtttgaggacagtgaaaaattcagtagctaagggttgtgtgctctctacacagggatggtgtgtggatttgtggataaggtatgcaacagagtactcctctttgagcatttttatatcttgaattaactatagcacaggagttggcagactatggcttgtgggccagatctggcccgctgcttgtttttgtgtggccacgaactaaggatagtttttacgtatgt

SEQ ID NO: 259286 - DNA, 553 bp, Homo sapiens
gcagcacagcctatccccagaccgcttagtccttcataacatatatctccacggaaaagggtatttcctcccgtcagaaaaagcgccccagtctggtctgggttggtttttatttcacgttgttgcaagtaggcgaagtcccttctgtctcctcccttggggtaagtggaaaggagtccggcagggggcccgcagtggcctgcacaggggaactgggtagcgagagagttccaggcaattccgggggctgccccacagaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacgcgagatcgcaaaccatgacaataggcagtcacccgaggtcaaataaaaacggagtgggtcccccgcgcgccgccgccccccgcgtccctggcggcctcc

SEQ ID NO: 259287 - DNA, 498 bp, Homo sapiens
tgcttgagcccgggaggcggaggcagtgagcagagatagcgccactgcacttcatcctcggcgacagagcaaggctctgtctcaaaaaaaaaaaaaaaagtgtaataccaacaaatagtgcctgcacatgttaaaatttaatgtttatacctaatatgctctataggatgacttgctggtttttgagcaaaggaaccagatagaagaaaaatttaatcttgggcccggcgcagtggctgcaatcccagtactttgggaggccgaggcgggtggatcacgaggtcaggaatttgagaccagcctaaccaacatggtgaaacacccctttctttactaaaaatacacaaaaaattagccgggcatggtggcatgcacctgtaatcctagctactcggaggctgaggcaggagaatctcttgaacccgggaggtggaggttgcagtgagccgagattgcaccgctgcactccagcctgggcgactgagcgtgctccatctc

SEQ ID NO: 259288 - DNA, 438 bp, Homo sapiens
acaagcattatttgctgataccacttttctgttgttggcctatatcattatacctgttcacatcatccagtgttcctttccccatggcacatttgagaaatggtacataactgtattgtctcatcctaaccgttaatcactttcccaaacatgaatattttccaggctgagcacggtagctcatgcttgtaatcccaacactttgggagaccaagatgggaggatcacttgagcccaggagtttatgagaccagcctgggcaacacagggagaccccatctctacaaaaaaattagaaaattagctgggcatggtggcatgcacctgtagtcccggctacttgggaggctgagatgggaggatcgcttgagcccaggagcttgaggctgcagtgagctgtgatcgcaccactgcactctagcctgggtgacagtgaga

SEQ ID NO: 259289 - DNA, 485 bp, Homo sapiens
ccactagattgtatcacaaaagttctagggagggttcttacttgtctaatgagatcatttgcttctccctgaacacatcactgtagcctggaaaatgggggtctctgattagctaggcctgggtcacattgcctactttcgtgatgatgaatagaagataggaattggggaggctatagacaaacatgattattatccttacaaaactacatgaaataagaaaggagtccccaaatggaaggggctgctattaccaaatggcaatgagggaaaaacattcaggacacccataatcattacctattacagtctatcatcgaccccttccatgcaaaggtgaagtggccatttattccagtgtcattgctagacttcttaacatttttcagaaggggacagcaatctgccactcagatgaccactgtgaagcatatgaatatattcttgatcggtaattttgaataattgaacgctgaatgttcaca

SEQ ID NO: 259290 - DNA, 502 bp, Homo sapiens
cacagccaaaccatatcaccccatttcacccttggatgacataacaacaagatgctgtctatgaagcagagagccctcactagacaccaaatctgttgccactgtgatcttggactttccagccttccgaactacgatcaataaatttatgttttttattaattacccagttgaaggcataggttatagcagtccaagtgctctaagacggtgtcgttttccacagtagagattatttttgtaggttatacaaatacttctgaagaacatttaaagctacatgtcagtcataccatagtgtaggcatagatatgtaacagatttatcccactctcttccactctgataactaagagtagatttgaatggagggctgaaggaggaaggcaaaattaaaaggataaatagagcataaaatactattttggaagggcagaagtgggtaaccgatggcatgagcaagagcattagacctcagagaaagaagacacaggtaggatga

SEQ ID NO: 259291 - DNA, 616 bp, Homo sapiens
  misc_feature (34)..(34): n is a, c, g, or t
gtctcggctggtgtatgttttctgcctaggatgnagtttcgctcttcttgcccaggctagagtgcagtggcacggtctcagctcactgcaacctccgcctcccgggttcaagtgattctcttgtctcggcctcccaagaatcatcttttagaaaacatgaaatacagggaatgatacaatattatgtctacgatttgcttcaaaatgatgtgtggataggggaatagatgaaacaagatgagccaagataatggtttaagattagtgatgggttacttttgtgttgatttaaattttctgtaataaaaaattaagattttaatgttaattacaaagtaatccatattcacatttcattgctattatagtcagattctgaaaatatctttaaataataattaatcatattaagatttacatctagaagacttcaataatttttctcacatgatggtcaacccaatacgcgtacttccaaagaagatgctatcatacagttttggcttgaattttaatgtttgcatttttttctcatcttgccttccctgtacaatgaaactctcgtattgtgggaaactgcggagaagtcagctgtcagtgtcctcctaggaaatca

SEQ ID NO: 259292 - DNA, 266 bp, Homo sapiens
tgttccctcctgcagaaggcgaggcagtgccaggctgcttcctgattggcagaaaaacagcaggaacttgattcctttcttaacccttccttgcggtttctgccacctccactgttctaagtggctgactgtgacaatgtctcgttcccactcccctctcattccccaggctggagaggacctactgggtttctatttaggatctgtgttatagtctgttttcatgctgttaataaagacatggacccaaggctgggtaatttata

SEQ ID NO: 259293 - DNA, 328 bp, Homo sapiens
actaacttcatcctcaaaaaatacttgaaaatacttgccatgtctgggcatgctggcccacacctgtaaccccaacactttgggaggccaaggtaagcaattgcttgatcccaagagttcgagatcagcctgggcaacatagtaaaactctgtctctactaaaaatacatggtgccaggcatggcaccatgagcatgtagtcctagctacctgggaggctgaggtaggaggatcatttgagctcaggaggttgaggctacagtaagtgatgactgtgctactgcactcccgcctagcctggaggaccatagagaggccctctctcaaa

SEQ ID NO: 259294 - DNA, 378 bp, Homo sapiens
atttttaaaactaacaaatactaagccaaacaccgccaggctctgctgcctcacagagtgtggcgatctgaatacacgtgtctctgtgggccgggtggtttggcttcgctccctgttctactgaaatcatacgccatgagatgttggaaggccttccaacatctcatccttgaactctcccacagtgtttaatgaatggctacattagtttttgtaatcccttaccatttacaaacaatatttatgtatattacttcttaattctacaataaccttattaggcaagtattaagactatctacaaacgagtaagtcgactcaacagtttcatcctatttccctcaagccatagatgactcaatagatgctgtgcaactg

SEQ ID NO: 259295 - DNA, 235 bp, Homo sapiens
gaaactgccaaatgaatgtttgaagggctgggccattttgtactcccaccagcagcataagagagttccagtggctccatatccttgtgaaaattttcaggaataagttttaaaaaggagctggagaggttctgtagatgagggggctgcagggcaggtggcaggagaggaggccagggaggagggcgacccatggatacaccagccacccccatcccctgcaacactgtccact

SEQ ID NO: 259296 - DNA, 411 bp, Homo sapiens
tctctggaggtgagttcaattcatgttcttatttgcttgctcaggtagcatcctttatagctttgctgatctaaaatatttcagttagactacagaatatatactaagtccttgtctggctaaaaactgttagattctaagaaactatcatcttggaatggcaaaattgtaatgtgaaaactagagcccaaattatttgatccttgcttgcttcaagatttatttatttatttatttattttttttttttatttttatttttttattatactctaagttttagggtacatgtgcacattgtgcaggttagttacatatgtatacatgtgccatgctggtgcgctgcacccactaatgtgtcatctagcattaggtatatctcccaatgctatccatcccccctcaaaccta

SEQ ID NO: 259297 - DNA, 238 bp, Homo sapiens
tgccaaattgcaacacgaagacttaatgaacaggcattccccctcccacgccacccccacccctgctaattgttcttttggcagctgattgttcaatacattctattttgtatgatctcttgaggtaaatggttgaaaaaatctgttaggtaaatagttaagagaaaacgtttttcctctttctcaaaccaacagcttgagtccttcttattaaatgtatttaattttttaaaactta

SEQ ID NO: 259298 - DNA, 380 bp, Homo sapiens
gcttccctttgatgggagtcacagtgttgtataacctaatctcagaagttacatgccatcatttttgccatcatctgttaaaagcaagtcaccaggttcaacccatataccagaggagaggcatgctcaaagatgtcaataccaggaggcagaaatcattgtgagccatcttagaagctgtacaccacactcccatttcacaaatcaagaaactgaggtactgccaggtgtggtggcacacgcttataatcccagcattttgggaggccaaggcaggaagattgcttgaggtcaggaggttgaggccgcagtgagccaagattgcaccattgcactccagcctgagcaacatagtgagatccttgtctcaacaacaacaa

SEQ ID NO: 259299 - DNA, 429 bp, Homo sapiens
ccatgcatactcgggccggcagtgtctttgcctcttggctttgtaatgttgacagtgacacaaaccacattgctgtgttgtggactgaatgtgcatctctccttgtaccccttaatccctatgttgaaccctaacactcagtgtggttgtgtttggagatgagacccgtaagggaggaactgagcttagatgaagccatagggtggggccctgatccaataggattcacattcttgtaagaagagacaccagaaagctccctctccctccatgcatgcacaccaaggaaaggccctgccagaactgcaggaaggcagctgcctgcaagccaggaggagcaccctcactagaaatggaatcagccagaaccttgatcttggacctccagcctccagaactgtgagaaaataaacctcttgcttcagccac

SEQ ID NO: 259300 - DNA, 274 bp, Homo sapiens
aggttgctgagactctgccagctcccacactattcccacgtccatgggcgcaggggccaggtcagtgcttccaaaggaggctgcatccttagtggctgtggctccctccaacaaaccctaaatgagatcttccttctcaatgtcacctgttgtcgtgttgttgtaactatcactgcagcttttattcacttcattgggtaatcactgagtttttcctccattgctgtagaacatgtggcttgctcttgtgtgtaaaaagactgaatttaaccgc

SEQ ID NO: 259301 - DNA, 442 bp, Homo sapiens
tttggtactcagtcagctcttggtaaatataaatcctccttgctaaaattattttcttcaaaatacttctggtatttgttttagatgacagttccccaaattgagaacttttgttacaaaactgctccagagacatctttgaaaacccaaggctgcaactgctgtcggatttcagaatgaaaaggaggttttcctctggcctctttcactcctcagtggactttaaagatgttgggaacaatttggtcttgttttatgtgtcgtggattctctttttgtgagatagttacctaaattagtaaaacatgtagacagcaaatgaaccagactcgcaataaccccctgagcaattggccctcaactacttacttcacaaggtcgtgttcaaggctgggtcaggagattgatgtgtataaagacagtttaaattctttgcagaaaa

SEQ ID NO: 259302 - DNA, 681 bp, Homo sapiens
tctgggctctgttccaccagttgtgtattctgccagacaggaattggacatatatccactcaattatccccagagagcaaaagctcctagagggcaggggccacctcatctccttagtcctccctgatgctgcacaactgccactgagtaccgagatctggagagaggacatatgggggcatcgtccattcttgaagcctattttccatgaagctttccttaattcccccaagctgacatttccatcctcctctgaatgtcacagacatgatccatgtgactcttcaccctgcattgtaatcagtggcttctatcttcttcctggttatctccccttccaaaacatgaggcttgtcactcatgagggtaaggcccatggttgattgtacttgtatccttcatagggtcttatatatattgggtcctagatatgtgtttatggactaaaaaattgtcttatgcatttaaagtctattaaaataactgcaaaatacacccctttccttggggaaagatggaccgactctggtcaacattgctcctcagattttaggtttcctttataacttttaaaaattaccatttcagctctggatttaaacagtaccacaattcgttatcaaattcttgcacatcatttcctccagagcatacgatttaaaagtcaaaaactaggtattg

SEQ ID NO: 259303 - DNA, 700 bp, Homo sapiens
cacactccctggtataggacatttaattaaaatcccaggagacagctagcccaagctgcacacagctccagctgagcctttcctctcccagattcaatgtcttcagacaacagaaactagatgggatatgccatgtgccactgactgtttcagcataatgccatactgacagtgaggcatgagggaattctgttctttaatttttattttatttattattattatttttgagatgtggccttgctctgtcaccaaggctgaagtgcaggggctcaatcatggctcactgcaaccttaacctcccaggctcaagcaatcttcccacctcagcctcctgagtagctgggactatgggcacatgcactaccatgacccgctaatttgttgtgtttttttgtttgtttgtttaattttcatttatttatttttttgtagagacagggtctcaagatgttgtgcaggctactcttaactcccgggttcaagtgatcctcctgctcccaaagtgctggggttatagtcatgagccacaccattgtgcctggctgaattctgttcttatgggcaagacaagaatgttagaagtaattttgattatactgaatttctgtctcacaaactggcttctgaatgtaatccctgcatgagatggcatatgatcctttatgtagcaaacagaatatctggaaaagacatttcc

SEQ ID NO: 259304 - DNA, 366 bp, Homo sapiens
atatgctgggagattagcatattttaaaatattttacgtaaaaatgaagaaaatgacatagaacaaagtgagcacaagggtcacattgagaggttttaactataattaaattttcatctaataaatatgataattataaagaaaaccagctggtttttggaagacatcaaagtgttctgtatcaagcaataatctccattaacctattctgaaaggcaggagcaggatggactgcatattctgaactttgggaggtaaatctgtgttggagctgctcactgtccatggaggagtggagcacaaagtatctgggggtgaaggtcatggcaccatttttcagcagggggaggaataatttttggtttg

SEQ ID NO: 259305 - DNA, 496 bp, Homo sapiens
gtactttatgttttaggagattacgtcagttttattttctattccttgtatttttaatttctgcaatcattttttaaaaaatttctagagtcctatttaatttcttctttttttaatgtggtgttctgttctcagttcatgaagcattctttttttcctatcgctaaagatttttattgatagtttttgggcttttttgaacatttagtttgtcctccaagttacttttttcgattttggtgtcgtctctcatgttagaagcttccttccagtgtctggtaactcttttgctttctgcttttatttataagtagggcaattaaaaagctaattggatttctgtgtgcatgagtgtggagggtttatcaactgtgggctttgctgaaggatgatatagctaggttatttccttgaagaactcctggtatgattatcttttcaggtccttatacatggtgtggtcagatttgccgcccccgcccccccccccccccaa

SEQ ID NO: 259306 - DNA, 840 bp, Homo sapiens
caaaaaagaaaaaaaaaaaaaaaaaaaaaagtagaaatgctaaccacctgccaaccccaacaggttcctctgacaatcagatgtaatgggtgggacaagctataccaatggatgacatcactatctcataacaaaaatatcagtgccagagagagtattataaggaaactgacactcagtaaggtttaatgagtaaactagattagcaacttcacattcactgagtgatttcacatccagtgtggcatctagtccacattttaagtgtaaatcccactatgaataacttacaggaaatcatttcatcatttgttctgaacctctgtttcttcatctgtaaaaagagaatgcgggccgggcgtagcggctcacacctgtaatctcagcactacgggaggccaaggtgggtggatcacctgaggtcaggaattcaagagcagcctgaccaacatggtgaaaccccgtctctactaaaaatacagaaatcagccgggcgcaatggtgcgtgcctggatcccagctactggggaggctgaggcaggagaatcgcttgaaccagggcggcagaggttgcagtgacacgagatggtgccattgcactccagtctgggtgacagggcgagactctgtctcaaaaaaaaaacctctcctccctgccctgtgtccccgagtatagacctcatgcacaggtttcctggctctccagcttccagatgggtctgcccagcaggaggcaccagcagaagtttggtgggaggaagaaagagaggtcagggtatttcttcccccacctcaatccttgacaggaaactggggctgcttcccttgaacaaagttatc

SEQ ID NO: 259307 - DNA, 404 bp, Homo sapiens
ccttttcgccaatgaatccagccctcctcagccttcaatgtgtccatgtgcctaatttctcctggttgtgacacaaaaacctggatttagctaaactaaggagcaaaacttctacatcagtttggtggcacatctggggatcaaggaagggtttctgatatctttgaagattgtgacactggaataaaggaaaacatacaggactcatgaagagctgacatgttcgtgaatatcaagcaaaacaagagttaatggaatggactgaactaatagaaaactgaaataatcttttttacttttgcttggaacactgctgattctcattttgtttttcagactcaaggaagcttattttgaactatttatggcctttaataattgagtaaggtaaactcctgtgaaca

SEQ ID NO: 259308 - DNA, 385 bp, Homo sapiens
aaataccctattatctcttaaattttacctaatctttgacgttagatgcaaccacattaaaacacaaggataccatggatttgaaaagatgcagttagcaattgactcctctcctcaatcaagccaccatactaatttcattaattttaaaacaatcccttattttatgtaaacaaattgttggacaccatttattagcattgcagcaggattttatgttattatcttttgaaaaacctttctaccacttttaccagttgctttgtgctaatttataagcttgtctgagtttaaaggagctgtaagcctaggcatggtgtctcatgcttgtaatcccagcactttaggagaccacggcaggaggattgcttgaggccacgagttc

SEQ ID NO: 259309 - DNA, 337 bp, Homo sapiens
tagggaaaggaagttcgtgacatggctatcaaatagacaactgatgtatctctaaaaaattccccaatgtccaaggagatacccccttattaaatatgtgagagtctcagagcactataattatttccgtgtcattaaatttagtacttaaatatcctttacttaaatattctgtcatgcaaattagtcttgtctccccaaagaaaatacatagaaactatatcccatactgtcttctacttattaagccagaagactgaacactttttagctgaataattgttactgctaagggtacagttgcattcctttaataaaacaaaacaaattcactcct

SEQ ID NO: 259310 - DNA, 803 bp, Homo sapiens
ctgtcccacgcgtacggtcagcttggactgccagaacaaaataccatggactgggtagcttaaacaacagaaattcatttctcatagttctggagtatgggaaatccaagatcaaggagccagccaatttggttttctggtgaaggctctcttcctgccttgcagatggcctcttccttgttgtgtcctcatatggcagagagagtgagctctggtctcttcttcttcttataaagactccaattccatcattgacaacctcatctaaacctaattacgaagagctctgaaatcatattgcttcagcaatggccaaactatttataagtatttcttctggaaggaaaagactctgaaggccataataactgttttcaaatatgtagagagctactgtaggaaagcagaattagagtttttctgtatggctcaaaaaaagtataagttttgccaataaataagtgaaagatacagggatatagatttcagctcaagatgaaaaattttccaggcaccgaagttgtccacatgctaaatgggtgcctgtgggtttctagtccctgaaagtgacactgggtatgagcattggcagaacacatattcaagcctcaaaaatcaatgtttagctttttacttattgtagcaattatcctttaataaattttctgagaaattaggtacccaaatcaccccttggactttctatttcatcctttatgatcattcttaagtttatggagttgcttgattctttgaatttaggctaggttgacttgacaataaaagtcttgtttcatggaatc

SEQ ID NO: 259311 - DNA, 709 bp, Homo sapiens
aaagccacctttgggaaagggcctgtttcatgccgcaagtgtaggagtataagtagaaaataacaggacaaaaagcacaaaacataaggctcacattcgttgtgcttgttatggtaggaagagattgtggcaaaacctggaaacacagccacgttacccaggaggcaaaaggactgcaggggagagagcgtgaacaaggaagcttgcctggcttccaattctgctccgttcccacactgggactcagttggttgccagttactgcgtgaattttctggcgctgggacaatgaccttccctgcatccacaggagccctctgagggagctggccactctgcctcctagtcaccgtgaggcttgttattaagctactgtgtatgtctgtaccttttgtaacatggacctgctgtccacaaggtcttcagcattgcttacaaactggcacgtaaacataatacatgcaaaacttgcatcctttgcagttccaggaagagagagaatggaaatgtccagagatctgttcttgattttgtgtttttatcatggactttgtctactgagtactattttaaacaagttttggtttttgtttcatttttgaaccttgatctagagcttgatgaatagattcctgttctcttcactaagtcttgacgtggagtggagttgataactgacagtggcgtctacctatttctgttgagataa

SEQ ID NO: 259312 - DNA, 680 bp, Homo sapiens
aaagccacctttgggaaagggcctgtttcatgccgcaagtgtaggagtataagtagaaaataacaggacaaaaagcacaaaacataaggctcacattcgttgtgcttgttatggtaggaagagattgtggcaaaacctggaaacacagccacgttacccaggaggcaaaaggactgcaggggagagagcgtgaacaaggaagcttgcctggcttccaattctgctccgttcccacactgggactcagttggttgccagttactgcgtgaattttctggcgctgggacaatgaccttccctgcatccacaggagccctctgagggagctggccactctgcctcctagtcaccgtgaggcttgttattaagctactgtgtatgtctgtaccttttgtaacatggacctgctgtccacaaggtaacaaactaaggctgtcatggatgcacactagggtttgcaagttaaaatttaatcctggtcttagacatagaagttatttttaaatttaagtgacacatgctgcacaacaaaccccaggttctagctttcactctacttttgcagttaactacatgcagtcaaaatttaaaagtgccaaacgctagcagatcaaatccataacattttcaaacagatgaattttatcacttacaatgtcaaatacaaaaagtgtatggaa

SEQ ID NO: 259313 - DNA, 4951 bp, Homo sapiens
aaatcatccgtagtgcctccccgggggacacgtagaggagagaaaagcgaccaagataaaagtggacagaagaataagcgagactttttatccatgaaacagtctcctgccctcgctccggaagagcgctaccgcagagccgggtccccaaagccggtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtccgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcgtatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatcacctttt

SEQ ID NO: 259314 - DNA, 884 bp, Homo sapiens
gagtagcaaatcagaaagtactgtgcctgatcttttaactcccagcccaatgtgctcttctactcatgttatttaaatagaagatttttgtaggtgtaccacataggaagagcaaatgaaataaactctttaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggtgaactaaacgcttgaaaaccgactgaggtcgtcggagaagacaggaaagagctgaatggagttgagctatacattgggaaacacttattttttcatttagtgggggagggggtgaagttgctggacttccctgtttcttaaaaatttggtttatgctccaagggctataggtgctggcataacgtttatacgtttttaacagcgaacagggaaggggatatcttttaaagacgacaaggggaaaatataaggaggtatgctataaa

SEQ ID NO: 259315 - DNA, 1992 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgtttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgttactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaatctagaatatttattattagctaaaatattcaggagcctataattttaagttaggcattagtgtcaatgtatgaaattctgatacttcatgtggaagacagtcattgatggatacctaaaagtatctaaaaagtagatatgttttttttattattattatatttttattattattacacttcaagttttagggtacatgtgcacagcatgcaggtttgttacatatgtatacatgtgccatgttggtgtgctgcacccattaacttgtcatttagcattagctatatctccaaatgctatccctcccccctccccccacccca

SEQ ID NO: 259316 - DNA, 1938 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgtttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgttactgttaactttgtgctttttaaaatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaatctagaatatttattattagctaaaatattcaggagcctataattttaagttaggcattagtgtcaatgtatgaaattctgatacttcatgtggaagacagtcattgatggatacctaaaagtatctaaaaagtagatatgttttttttattattattatatttttattattattacacttcaagttttagggtacatgtgcacagcatgcaggtttgttacatatgtatacatgtgccatgttggtgtgctgcacccattaacttgtcatttagcattagctatatctccaaatgctatccctcccccctccccccacccca

SEQ ID NO: 259317 - DNA, 1853 bp, Homo sapiens
  misc_feature (1)..(1): n is a, c, g, or t
ntgaggcgctctcaggagctgcgggagtagtccaatagtggcacatagtaattattaagttgatttttaaaaattttatggtattctcttttttaagttaagagaaaataagcaagtaatcactatttgaagcagatatttaatgcttgcaactatatcatcattaaatattaagacatcaaataatacttataaccttaagctatcagatgaactttgcttttttatggcagacaggtctttgagggaaaaatcatttaaaatttgaaaatcgggttgtttgtaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgtttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgttactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaatctagaatatttattattagctaaaatattcaggagcctataattttaagttaggcattagtgtcaatgtatgaaattctgatacttcatgtggaagacagtcattgatggatacctaaaagtatctaaaaagtagatatgttttttttattattattatatttttattattattacacttcaagttttagggtacatgtgcacagcatgcaggtttgttacatatgtatacatgtgccatgttggtgtgctgcacccattaacttgtcatttagcattagctatatctccaaatgctatccctcccccctccccccacccca

SEQ ID NO: 259318 - DNA, 3323 bp, Homo sapiens
gtttatgtttgttcattcatcgaccaacagacaacacaccaggaagagctttagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatcacctttt

SEQ ID NO: 259319 - DNA, 1339 bp, Homo sapiens
aattcgcggccgcgtcgaccggctgcgagaagacgacagaggggggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgtttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgttactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgataccaaatttgtaatctagaatatttattattagctaaaatattcaggagcctataattttaagttaggcattagtgtcaatgtatgaaattctgatacttcatgtggaagacagtcattgatggatacctaaaagtatctaaaaagtagatatgttttttttattattattatatttttattattattacacttcaagttttagggtacatgtgcacagcatgcaggtttgttacatatgtatacatgtgccatgttggtgtgctgcacccattaacttgtcatttagcattagctatatctccaaatgctatccctcccccctccccccacccca

SEQ ID NO: 259320 - DNA, 2845 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtccgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcgtatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaaggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaataaattta

SEQ ID NO: 259321 - DNA, 823 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgggtgaggccattattaaataaaaatgaagttaaagtg

SEQ ID NO: 259322 - DNA, 684 bp, Homo sapiens
  misc_feature (1)..(1): n is a, c, g, or t
ntgaggcgctctcaggagctgcgggagtagtccaatagtggcacatagtaattattaagttgatttttaaaaattttatggtattctcttttttaagttaagagaaaataagcaagtaatcactatttgaagcagatatttaatgcttgcaactatatcatcattaaatattaagacatcaaataatacttataaccttaagctatcagatgaactttgcttttttatggcagacaggtctttgagggaaaaatcatttaaaatttgaaaatcgggttgtttgtaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagtcttgagagctgatgacaataacatgggcaatggctgctctcagaagctggcgactgctaacctcctccggttcctattgctggtcctgattccatgtatctgtgctctcgttctcttgctggtgatcctgctttcctatgttggtgggtgaggccattattaaataaaaatgaagttaaagtg

SEQ ID NO: 259323 - DNA, 735 bp, Homo sapiens
gtttatgtttgttcattcatcgaccaacagacaacacaccaggaagagctttagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaaggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaataaattta

SEQ ID NO: 259324 - DNA, 1660 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgtttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatagagtacttttcttgttactgttaactttgtgctttttaaaaaaagtgattctctaacagacctcttaaattgtgacatgaaggtatgtaattagatttcagaaattggtttattagtgaggaatttttatcaataaatgtcatggggcgtgttcttcagaatatatagttattttcaacaaatgccaggctagattcctcacatgtggctatttcttatgtaagaagcttttaactgaagttggcatgtttcgtaaaacttgcgtgtcttttaaaaataataaaaggaagatgagtatttatgaagaatatgtgctgacaacagggcttatgaggtctatgtaccttaatctcgtttctccttaccacaatcttaaatagatttcagctgaaaataatcagttcttatgaaaacaaatagagaaatatcagtaagtcaaatctgtttgaattataattcctttcaaatagttttgctatttaatttatatgattaatgttttcattaaaatttttgatacca

SEQ ID NO: 259325 - DNA, 5233 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagtcttgagagctgatgacaataacatgggcaatggctgctctcagaagctggcgactgctaacctcctccggttcctattgctggtcctgattccatgtatctgtgctctcgttctcttgctggtgatcctgctttcctatgttgggtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtccgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcgtatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtgtgaccctctctataaatgtgaactcctcttcctttctgatggttcacagagctgccacagaacaccatgtgtgtgcagatggctggcaggagatattgagtcagctggcctgcaagcagatgggtttaggagaaccatctgtgaccaaattgatacaggaacaggagaaagagccgcggtggctgacattacactccaactgggagagcctcaatgggaccactttacatgaacttctagtaaatgggcagtcttgtgagagcagaagtaaaatttctcttctgtgtactaaacaagactgtgggcgccgccctgctgcccgaatgaacaaaaggatccttggaggtcggacgagtcgccctggaaggtggccatggcagtgttctctgcagagtgaacccagtggacatatctgtggctgtgtcctcattgccaagaagtgggttctgacagttgcccactgcttcgaggggagagagaatgctgcagtttggaaagtggtgcttggcatcaacaatctagaccatccatcagtgttcatgcagacacgctttgtgaagaccatcatcctgcatccccgctacagtcgagcagtggtggactatgacatcagcatcgttgagctgagtgaagacatcagtgagactggctacgtccggcctgtctgcttgcccaacccggagcagtggctagagcctgacacgtactgctatatcacaggctggggccacatgggcaataaaatgccatttaagctgcaagagggagaggtccgcattatttctctggaacattgtcagtcctactttgacatgaagaccatcaccactcggatgatatgtgctggctatgagtctggcacagttgattcatgcatgggtgacagcggtgggcctcttgtttgtgagaagcctggaggacggtggacattatttggattaacttcatggggctccgtctgcttttccaaagtcctggggcctggcgtttatagtaatgtgtcatatttcgtcgaatggattaaaagacagatttacatccagacctttctcctaaactaattataaggatgatcagagacttttgccagctacactaaaagaaaatggccttcttgactgtgaagagctgcctgcagagagctgtacagaagcacttttcatggacagaaatgctcaatcgtgcactgcaaatttgcatgtttgttttggactaatttttttcaatttattttttcaccttcatttttctcttatttcaagttcaatgaaagactttacaaaagcaaacaaagcagactttgtccttttgccaggcctaaccatgactgcagcacaaaattatcgactctggcgagatttaaaatcaggtgctacagtaacaggttatggaatggtctcttttatcctatcacaaaaaaagacatagatatttaggctgattaattatctctaccagtttttgtttctcaagctcagtgcatagtggtaaatttcagtgttaacattggagacttgcttttctttttctttttttataccccacaattcttttttattacacttcgaattttagggtacacgagcacaacgtgcaggttagttacatatgtatacatgtgccatgttggtgtgctgaacccagtaactcgtcatttgatttattaaaagccaagataatttacatgtttaaagtatttactattacccccttctaatgtttgcataattctgagaactgataaaagacagcaataaaagaccagtgtcatccatttaggtagcaagacatattgaatgcaaagttctttagatatcaatattaacacttgacattattggaccccccattctggatgtatatcaagatcataattttatagaagagtctctatagaactgtcctcatagctgggtttgttcaggatatatgagttggctgattgagactgcaacaactacatctatatttatgggcaatattttgttttacttatgtggcaaagaactggatattaaactttgcaaaagagaatttagatgagagatgcaattttttaaaaagaaaattaatttgcatccctcgtttaattaaatttatttttcagttttcttgcgttcatccataccaacaaagtcataaagagcatattttagagcacagtaagactttgcatggagtaaaacattttgtaattttcctcaaaagatgtttaatatctggtttcttctcattggtaattaaaattttagaaatgatttttagctctaggccactttacgcaactcaatttctgaagcaattagtggtaaaaagtatttttccccactaaaaaactttaaaacacaaatcttcatatatacttaatttaattagtcaggcatccattttgccttttaaacaactaggattccctactaacctccaccagcaacctggactgcctcagcattccaaatagatactacctgcaattttatacatgtatttttgtatcttttctgtgtgtaaacatagttgaaattcaaaaagttgtagcaatttctatactattcatctcctgtccttcagtttgtataaacctaaggagagtgtgaaatccagcaactgaattgtggtcacgattgtatgaaagttcaagaacatatgtcagttttgttacagttgtagctacatactcaatgtatcaacttttagcctgctcaacttaggctcagtgaaatatatatattatacttattttaaataattcttaatacaaataaaatggtaatggtctaatcacctttt

SEQ ID NO: 259326 - DNA, 2953 bp, Homo sapiens
gaatcttggattgtcagaatcacacatgtatgaaagaatgccacaaagtaaccaaaactgatggctgcactggaaaaaacaaggctggcccagaatgccttcattgtgaggaagggtgctccaagtcacggccactaggttgtcttcacccatgtattttgcgatgtcaccctggagaatgtccaccttgtgttcagatgcttagaataaaatgtcactgtaagatcacaagcctgtatgtggaatgtagaaaaataaccacagctgatgtaaatgaaaagaacctcctcagttgttgcaaaaatcagtgccctaaagagcttccttgtggtcatagatgcaaagagatgtgtcatcctggtgaatgtccctttaactgcaaccagaaggtaaaacttagatgtccttgtaaaagaataaaaaaggaattgcagtgcaacaaagtacgtgaaaatcaggtttcaatagaatgtgacacaacgtgcaaggaaatgaagcggaaagcatctgagataaaagaagcagaagccaaagctgctcttgaagaagaaaaacgaagacaacaggctgaactagaagcttttgaaaacagactgaagggtcgtcggaagaagaacaggaaaagagatgaagtggcagtcttgagagctgatgacaataacatgggcaatggctgctctcagaagctggcgactgctaacctcctccggttcctattgctggtcctgattccatgtatctgtgctctcgttctcttgctggtgatcctgctttcctatgttggaacattacaaaaggtctattttaaatcaaatgggagtgaacctttggtcactgatggtgaaatccaagggtccgatgttattcttacaaatacaatttataaccagagcactgtggtgtctactgcacatcccgaccaacacgttccagcctggactacggatgcttctctcccaggggaccaaagtcacaggaatacaagtgcctgtatgaacatcacccacagccagtgtcagatgctgccctaccacgccacgctgacacctctcctctcagttgtcagaaacatggaaatggaaaagttcctcaagtttttcacatatctccatcgcctcagttgctatcaacatatcatgctgtttggctgtaccctcgccttccctgagtgcatcattgatggcgatgacagtcatggactcctgccctgtaggtccttctgtgaggctgcaaaagaaggctgtgaatcagtcctggggatggtgaattactcctggccggatttcctcagatgctcccagtttagaaaccaaactgaaagcagcaatgtcagcagaatttgcttctcacctcagcaggaaaacggaaagcaattgctctgtggaaggggtgagaactttctgtgtgccagtggaatctgcatccccgggaaactgcaatgtaatggctacaacgactgtgacgactggagtgacgaggctcattgcaactgcagcgagaatctgtttcactgtcacacaggcaagtgccttaattacagccttgtgtgtgatggatatgatgactgtggggatttgagtgatgagcaaaactgtgattgcaatcccacaacagagcatcgctgcggggacgggcgctgcatcgccatggagtgggtgtgtgatggtgaccacgactgtgtggataagtccgacgaggtcaactgctcctgtcacagccagggtctggtggaatgcagaaatggacaatgtatccccagcacgtttcaatgtgatggtgacgaggactgcaaggatgggagtgatgaggagaactgcagcgtcattcagacttcatgtcaagaaggagaccaaagatgcctctacaatccctgccttgattcatgtggtggtagctctctctgtgacccgaacaacagtctgaataactgtagtcaatgtgaaccaattacattggaactctgcatgaatttgccctacaacagtacaagttatccaaattattttggccacaggactcaaaaggaagcatccatcagctgggagtcttctcttttccctgcacttgttcaaaccaactgttataaatacctcatgttcttttcttgcaccattttggtaccaaaatgtgatgtgaatacaggcgagcgtatccctccttgcagggcattgtgtgaacactctaaagaacgctgtgagtctgttcttgggattgtgggcctacagtggcctgaagacacagattgcagtcaatttccagaggaaaattcagacaatcaaacctgcctgatgcctgatgaatatgtggaagaatgctcacctagtcatttcaagtgccgctcaggacagtgtgttctggcttccagaagatgtgatggccaggccgactgtgacgatgacagtgatgaggaaaactgtggttgtaaagagagagatctttgggaatgtccatccaataaacaatgtttgaagcacacagtgatctgcgatgggttcccagactgccctgattacatggacgagaaaaactgctcattttgccaagatgatgagctggaatgtgcaaaccatgcgtgtgtgtcacgtgacctgtggtgtgatggtgaagccgactgctcagacagttcagatgaatgggactgtggtgagctacttgtttctgccatctgttgtactctctcatgcctgtcagccactgaagctgaatggatcctaaattacttcctggattttactgaccaagttcatctattttgttttactgttataaaagctgatagtgctgatctatgtgtgttatttccaactcacagaaaatttccccacgaagctacttctctatttgaaatatctatattgtatggaaaaacgtttgggttcaaaatgttgtaatcatataattgctgggagaggatttaaaaactcttcattaaaacccaacttcaataaattta

SEQ ID NO: 259327 - DNA, 304 bp, Homo sapiens
ggcgcagtcttggctcactgcagcctctgcctcccatgctcaagtgatcctcccacctcagcctcccgagtagttgggactacaggtgtgagccaccatgcccggatattttttgtatttttagtagaaatggggtttcatcatgttggccaggctggtcttggaactcgctgagacaggcagactgcttgagtccaggagttcgagaccagcttgggcaatatggtgaaacccatctctacaggggaaaaaaaaaaatagctaggagtggtggtgtgtacctgttgagtcccagcaggactca

SEQ ID NO: 259328 - DNA, 299 bp, Homo sapiens
ttttttttggagacagagtctccctctgcagtccagccttggcaacagagcaagactctataaataaataaataaaaaacccactgcacctggcccatttttttttaaattatactcatggcctggcatggtggctcatgcctgtaattatagcactttaggaggctgagacaggcagactgcttgagtccaggagttcgagaccagcttgggcaatatggtgaaacccatctctacaggggaaaaaaaaaaatagctaggagtggtggtgtgtacctgttgagtcccagcaggactca

SEQ ID NO: 259329 - DNA, 499 bp, Homo sapiens
tcattacttatgttattagtagggtttccagtcacctgtagtctatcagtagttacgttttgggggagtcaagagttatagcagattttttattgcctgagggtttgtcccctaatctccatgttgttcaagggtcaactatagatgcttttattacacatctcctttgaaaactgggtagcatataattaatacattttagtcctgcctgacactcatttaaaacaagcaaacagagatcccaactaataacatgaatatgtgagactttaaactatttttattacatacgtaattatcatactacaaatcccaaagattttcttttgatttacatagcagaatattattaatcaagttatcactaaaataaaggcatttctttgggaagtcagaggaatatagtccagacatacagttggcccaccaaatccttgagttctccctccttggatccaaccaactgcagatcaaaaataatgaaggtgaaaaaatagaa

SEQ ID NO: 259330 - DNA, 277 bp, Homo sapiens
aaaaaaaagactcaagcatggcaaattaaacatatgaaaaaacgtccaacatcattagccattattagggcaataaaaactacaacaaaatgagataccactacacacttattagaatggttaaattaaaaatactgacaataccaagagctgacgaggatgtgcagagttgtattccattgtatggatgtaccattgtttatgcatttaaccattaaagaacatttgggttgttttcagcttttggctaccataaataaagcttctgtgaacattt

SEQ ID NO: 259331 - DNA, 546 bp, Homo sapiens
gcttagtgagatttgaatatattaggaacattaactttttaaataaatgtagtttcctgtctttttgatcaatgggagggcagctgtgcctaatttaggactgatttattctaatctctcttaataaatgcttgtattcagagtctgtttggaatttaacccaatgcttagaactccttaaatatacagaaatatattttaggggtaattgattcatggaactctcctactttggagcacaattgttataattgtccagaaactggccaaataatgtagaacgcgcaagttgttgggaagcccttttgtttcctgatagttacatgtaattccagcagtatttggaaataatttgctaagatgttagaatgtaacatttgaagactcgttagaaaaatcaataaaattatctttggctaataggtggtacacatcttagtctatttaatatgcctttccaaatactgtgtctgttgagaattggtgtatataactagatgactttaataattagtgcctgagtctagaattgagatgtttagtcgt

SEQ ID NO: 259332 - DNA, 1061 bp, Homo sapiens
tttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtgggggtgggagacatattggaatcgtgttttctgggataaaatttttaaaaagaattaatcattagccctgagtattttagtcatttgtgcctatagaaaacaacatgctcttttattgtggactttcttcttttaagtgaggtttaatttatatacaatacaataacagatttttaagtattcatttgagatgttttgacaactgtatatatacatgtaaccatcactggaatcagatatagaatattccccttaaatattgtcaggtaaacacattgagaatattttttccagtctgtggcttacctacttattttcataatgaatgttttacttgtgatgaagatttaacttacccttttactttaatgattaatattttctgtgttctttctaataaattttacgaactctgagttataagatttctcctaagattttt

SEQ ID NO: 259333 - DNA, 734 bp, Homo sapiens
tttgagacagagtttcactcttgttgcccaggctggaattcagtggctcgatcttggctcaccacaacctctgcattctcctgcctcagcctcccgagtagctaggattataggcacctgccaccatgcccggctaattttgtttgtaattttagtagagatggggtttctccatgttggccaggctggtttcgaactcctgacctcaggtgatctacccgcctcagcctcccaaagtgctgaaattacaggcgtgagccacctcacctggccatgttctttatggaatactacaatgtgttgtcacaggatttgttattcagatgtcaatcatttttatttatatatttctgggtaaaacttattagtggtgtgaggagtgcagaatatggaagcttacctaaattctttttctgccagccaacattttaaaagacaaatgatgcatcctttctcaatgctgctaattctttaaattttacatgtcccaatttattccatttgagatttattttaatgttttcaacccctgtgtaacatgtatcatgaggagaaagcactatcattgatcatcactatggattaaaatataggaatattttacagggcagtatgggtggggggacttttttttttaagggaggttaattatttcctccataacagttttttagattatttgggatggttggaactgttttttccatgtacctattgtgataaatttgatatca

SEQ ID NO: 259334 - DNA, 400 bp, Homo sapiens
agtctctacccaccatactccctggaagtggagagcaatcacagatctgctggtttctttctctgcacctggcaacctctggagggcaaggcctgcacttttccagctgtgacaccagcccatgtgtctcatatcatttctctctcatgtagcaagaatttctccccagaaaggaggtggcaaagatgggcagggggtgcaaaggtgggggctctgacagccaggttccagggtgcactgctgagccagcccacaaccatggtgaggcagggagattccgcaggactccgtatccgtgctttgaagatggctttcgtgcttttagtcttttctttgttcatttgttgtttgttttctgatgatgttttagtaaaaagttcttttgaaaatcccaagcttt

SEQ ID NO: 259335 - DNA, 467 bp, Homo sapiens
tttttacaattttgggtgtctatctttggcatgtttcctgttatgtgagcatgacatgctgtgtatgtgagtgagcttgtagggcgtggtgggacttaggcatttgcagacagtgtttagatgaaagattacatgtaatgataaatctgaatccctccattttatttgggtggaaccatgaccaaaaatggtaggaagacgaaaggccagaaagagactttgccagagagttcacggagttttcttaccccgcatgctgactaaagaaaacatgggcttttctgaaaccagcttcaactacagtataaactatatcagaagcttacttgataagccttgcggagctgctctgaggaatagtgtgaattccttccttgccttattgttgactgttaatgaacatgttttgtcatttatctgtttaagtttttcagaaaataaaagtaaatttctgttagcacatttta

SEQ ID NO: 259336 - DNA, 546 bp, Homo sapiens
agcacagggcagagtgtcttacttcattcttatatgctgctgagcttgatgtcgactcagtttgtatttgattcctgaagttagaatatctcagaaatctttctttgggcagtatttgctaatgtaattattatttatcccagttcattccatacattaagtattctggaagggtatttaactcttcacattcttattggccaaccagtatctaatacatggaatgaggtttcaggccctgcctccactgaggcgcttcccactgggaagtactagagaatatttttaaagagtctctgtggacacacagcaagttttaggtttttttgtttttgtttttgtttggtatatctagaaacacactttgtgaatgtgaaaggttctcttgtacccaactagaaataatcactgactgcctctgaagataatgatggagaatttgttaaaagatttctctttaattataaagtggctatgcaaatgtgattacagtttaaatttattttcgtagtgaaaatagcttttgggggcattcaggcattctag

SEQ ID NO: 259337 - DNA, 819 bp, Homo sapiens
cccttctgctttccacctatgaaaatataatgttcatctgctctggaggacacagcaaggtgccatcctggaatgagagattgggccctcaccagataaggaacctgctgatgccttgatcttggactttgcagcctccaaaaactatgaaaaaataaatttctattatttataaattacccagtttcagatattttgctatagcagcacaaatggaaatgccctttaaagtttctcagattgctcctgtgtttcatagatgggaaatcatactgatgactcaaccatatatagcattattttgctggttcatgctacctcagcggaaacagctgccaaaggtcatctgacataatagctgatgaattcaagcccagtggatttcatttgcaattttcaatttactgaggcctccaaaccccacggtgataaaagcttcccctatcgtggcctgtcacaaacatcaagaaactgcacaaacccacaagaaagaaaaaagagaaagctgtgcatcatcacagctatagataaggagaacaggaagaaatggtatcatgcaggaagatggggagcagcctgtgtggctagttctctaaatgccaattgaaacgaaaagactatgaggaacaatcaaataacttccacagaataacaacatgtttctttggagcttttatgtgaaaattgccttctaatctctgacttgacatgctcccacacaaaaatgtaagtgtaaatatgcaaataaataaatgaataaacaatgatgcggccgaaaacccttatccgctctccgaaacggccgcatgcacatcaaaa

SEQ ID NO: 259338 - DNA, 1579 bp, Homo sapiens
cccttctgctttccacctatgaaaatataatgttcatctgctctggaggacacagcaaggtgccatcctggaatgagagattgggccctcaccagataaggaacctgctgatgccttgatcttggactttgcagcctccaaaaactatgaaaaaataaatttctattatttataaattacccagtttcagatattttgctatagcagcacaaatggaaatgccctttaaagtttctcagattgctcctgtgtttcatagatgggaaatcatactgatgactcaaccatatatagcattattttgctggttcatgctacctcagcggaaacagctgccaaaggtcatctgacataatagctgatgaattcaagcccagtggatttcatttgcaattttcaatttactgaggcctccaaaccccacggtgataaaagcttcccctatcgtggcctgtcacaaacatcaagaaactgcacaaacccacaagaaagaaaaaagagaaagctgtgcatcatcacagctatagataaggagaacaggaagaaatggtatcatgcaggaagatggggagcagcctgtgtggctagttctctaaatgccaattgaaacgaaaagactatgaggaacaatcaaataacttccacagaataacaacatgtttctttggagcttttatgtgaaaattgccttctaatctctgacttgacatgctcccacacaaaaatataaatggtagatcctttgattgatttgccagggaagtcaaaggactgacatagcaactacttgtaagtggatctagatgtagtacatatcaaagatgcattagcaagaagaagaaagccatttttccccctgtcaaactatttacaatgaacttaggcaggatcgggaactgaatcctgttcccaggcagttgttcaaattgagcaaaccatatgtgtgtttcttggagaatagcaagtttgataactcagcaggtcacctttgtcctatcctacttgactcataccacggcctggaaaaggagaaagcaaatagatgtccactgcttgaggtgtagctgctgggagaatttagtttcaaacggagatgtcttgatcctgtttctaccaaataggttcaggaaggcttatgaagtttgtctgatgcagtaagaggacttggcagtgggcatgtaccaacctgccgaatgccaatatttctgatgacacgtgacaagaaaatctgagaatgatatcaacaggaccagaatattaactttatttgtgtgttgctaactgtgtgacaatcacagtttggaaaggaaaagagaataattcctagttgaactcatatggcagtgagagattgccttctgtagagttattctttaaaattgtcgcagcaaaaacaaaagtaggagctacttgttgtaagtgaatcttgagttctttgaaattaaactgtttcttaagattcttctattagcaaaaaagttagcaatcttttaattcttcaaagtctcaacatagaaaatagtttcctcagtagtcgaaaatgacaggaattaacattttgaaataagagaaataaaac

SEQ ID NO: 259339 - DNA, 468 bp, Homo sapiens
gtgctgggattacaggcatgagccacctcacccagccgcggttagatctttctttttaggagataagccaggcagaggttgaggatcacaggagccattgtcattctggcacggctggagcagagtttctgtggccatgtgtcccctgtggtggcaggcaagagaacacctgggcaggaaggccacagatgagaagcagctcaaaccaaggccccaacctgcaggggtttttctggctctacctatgaagcctcctaacctgttcaaagcagtattcaaccagccgaagcagcttgttttccacagggaatctggaggtgactattgctagtatttggagcccaggaacctattcctacacatacccatggccctgtctctattttgccctatctacatgtaaggtttgtgtcagccttgcaaaaggggctgtgggctgagaaaataaagcctggcttcctctctgaa

SEQ ID NO: 259340 - DNA, 583 bp, Homo sapiens
taacagcacctcagagaagatttggaaaataaatgagctgatgagagcaattttctgcttcctgggccaccacagtcttctttgctgtttttgattgcaaccattttcagagaagaatcaacaccaaagattacatgtatataaattacctagtaacgagcatgacctctgtccaagcagaaggcaagcaggggagaagatttagctgctcaactacagttattctctcaacccaagctaaggtagttggtgccatacatttcccacaggactactattttccaatatcaacatctttaatttatttatttatttttgttttagtgcactagctggaagtttcgatataatgttaaatacaaaggatgagagtaaatattcttacatttttcctggtcttatgaagaaagaattttctttcaccattaagtattatgttgtctgtaggtttttcacatatgttcatagtgggttgaagcactctctttttagtcctagctgagagttttaggttaagaataagtattatttattattattattatttatttattattataaataaaatacatttattacatta

SEQ ID NO: 259341 - DNA, 474 bp, Homo sapiens
cactttctcgagaaagaggttattttgcctcttagcagcagtagacaaatatatgcaaacagtctaaacaaaagcctatgtattgcttgaagttaaattaaaacttgttcagacagggcattgacactgacagtagccacctcaactcaacttcacctactgaaaaaaatctactaaacgacacctggaactcattacattctttcatttgagttttgctgccttaatattgtatcacactgagaatctaagtattatctggctttctttcaagtattgtttcctgagaagttatttgcctaaaattcattcatactcctctaatctttcttcctctcccctcacctccccttttttcctccaccatttcctttggactttcacactccagaattcaaatgataccactgggtcctagggggttgtgtactataatttatgtggtgaaggacctggtgatttgatgtgaaaata

SEQ ID NO: 259342 - DNA, 444 bp, Homo sapiens
gcagtgagctgaaatcatgccactgcactccagcctgggcaacagattgagactccgtctcaaaaaaaaaaaaaaaaaaaaaaaaacatcagaacacacatataccaacatcaaatgtaaagcataatggcaaaaaaattttagaagagaaggttctagtggaacaggggtaaagaagatgatgagccatctaagaaagaaagaacatcagcatactcatactttagggtcctaattaaaagccaataaagtgttagctagaggaagaattttttgattacatgtgtcattgcaagcaggtgttcactatgcctgaattcctgctactaagtataaggaatgggtgagaatgttatttacccagaaacactaatgtctatagttatgttttccctaatgataaatcgttaagttctgtcaataggatacttattaaaaaaaaaa

SEQ ID NO: 259343 - DNA, 723 bp, Homo sapiens
gatttttttattattattagaccagggaaaggtcaggaggaggagtggagaggatctgataaaattagaaagattagaagaaataatagaaatgatagacttgaaataataggatgatggaaatgataggtggggattagggagatgcacgtctcacatttcctggaaattgtgatgtgtgaggcccatttcagatgcatttcctaagcatgctcacagcagcgtgctaaatgtatccactttcattcaacaagcatttcctgagacctcttctggtcagccagagttatattctgggagctcagttctaaatactccctgatcttaagtagctcacagcctaatgagggacgcagagagcagtgatagtagagagtgctttggagcacacaggaaggtgttgaggtcattaggagaaactgtctcagctgagtcttgaaggataagcagggattagccagatgatgaaggggtgggagggtgattctacccagaatagaagcactttggcactcatatagcaacatgaggaacagaagtcattcaggatgtccagagcaaagaagatgtgcgtttgcaccaagaggtgaccctggagaggatacaggactcttacatgtgtgttcagacctaaagtgtgtgttgtggggagcctgtgacaggttgtaagcagaggagcaatctagccatatggagactgcgttgagagtggaaatctagaag

SEQ ID NO: 259344 - DNA, 430 bp, Homo sapiens
gccctgatgttctagcatgtgattacttcactcctggactgtgactttcagtgggagatggaagtgtttcagagaactgaaactgtggaaaaatgacctttccttaacttcaagctactcttaaatttgagggtctggaccaaaagaagaggaatatcgggttgaagtcaagataactgataaggagagagtaatgactaactccaaagatggcttcattgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgt

SEQ ID NO: 259345 - DNA, 225 bp, Homo sapiens
aggctgagagaacagggcgggcacttggctttttacacagccagtgcagtctgcacatatagaaacgggtagaggcagcttccaaaattatgggaatagatgcatttttttttcctcaagcacttgagttatgtaattaagttgggctttgtagagatgttatttacaaggctttggtggggaacaaaatttactatctttttttttttggcttctaatttgtgg

SEQ ID NO: 259346 - DNA, 354 bp, Homo sapiens
cgcaagcatcccttcctttgcctggttgtattgcccctttcctgcactgcccattgcttctctttcctggacatcattagcctaccctttaggagccagttcagatgctgcctcctccaggaaaccttttctggtccagaagtcatctcttcctcttaaggttttgtgtagttctttctagtctcctttctttatattgattctatcacttacagcattcctccttagtttgcagctttctgtgccttactaggatagcttccaggggacagtaaccaagttttttttttttttttttttgctttttttccccagctttactgagatataattgacacataaaaattgtatata

SEQ ID NO: 259347 - DNA, 475 bp, Homo sapiens
gccgcccagggctgccaatgccccggcggcgctgttctgaacaaactgttttggccagcctgtgaaatccctggaaattgacgattccagcaaagcgtcgtgaactgggaaagcaccaaatgttctactcaaaagccgcgaagggacaaaacaagctagacccgaggcccagatgaagcgggaggaggaggcttgcgagaggaagttcaaggggggaggtactaggcgggcagttcaggcacgaggcacaggtcccccatgggtgaaaggatgactttacccggaacactgggaaccttttcagagcacaaacaaaaaacattttcaactgaccgctccaagtgaatttcagttcaactcaaaataacaaaattactaagtcggaaaggacttctgaaattttctagtaaacaacggtctaacgaatacatagaaatgatgtttagggtttatattagccacatatagaatggag

SEQ ID NO: 259348 - DNA, 339 bp, Homo sapiens
ataagtgaatggaagggatgtgtgctatagggaaactttggagtgttttctaattcatccaagaaagtcagcccttcagttctttacctatcacagaacaggtaagtagcacccgcctcatcatcgcactgtggtggcgcccactcccactggggatttgaacacagggaggaagctgggctctaagactacaggagcctctgcttgggtgacagccaaggtgtgtggctgctagcagttcttcagccactccagtttgacagaagcttttcttttcatttatgacaccccccaccttcctgagatcttcacagcagtagcaaaccagggaatcttgta

SEQ ID NO: 259349 - DNA, 410 bp, Homo sapiens
agtaaatagcctgtttaactgtgtttaatccattgtttcccatctttgaacgaaatatattttcccttttttaatatttattttttgtttacttataaaatcttgacagccagaagagatcataagggtagcagtcctcagttgccagtcggtgagtggttaccatgtgaggactaaccactttataatcacttactcatagatcgtcctgtgtattttactaaacacacacacacacacacacacacataaatagcacatgaccctaatttctgagaagtacagtaagtattgactgtattgaccacacaccgttttgtgtatgatatctgtttcaagcctttgtccttgagacatgggctgttttgcccagtgatgtttactaaaataaaagcaagccttaaatgtca

SEQ ID NO: 259350 - DNA, 1059 bp, Homo sapiens
tacatactttaaccaaagaaaagcataacttataccataatgaggtaatcattagattctgagaggctaattagaataagttatttatatactttgtaaaattgttcagttcctatagaatagcataatggaaaaacgaagaatagtatcacgagtcagaactggatgctagccttaattctgttattcactggtttgggaaagtctattaatcaactgatctttaatttcttcatctttaatcaacaaaccactctgacagtctatgccaacaattaggatgaaatgaaatatgaatatgaaggtgctttaagaaaaaaaactatcgaatgctattcagttacagagaactgtaactgctaaaggataacagtattttcagtgaatgcttcgaataattcatattgttttctgctttcattaatgactgtatgtgaaactcagaaaaatggcaggtggccttactatcaactttgcagtactaattttacttctctgaatattttatcataagagaagcacaagactaagtctgccaaaggccagcaatttaaacagaatgattctaaaaatttataatatcttgcctattattaaaattttctgtaactggaagacaggttaggaaattttataatccacagcgaactaaagcacagctgtttacctgctgaatacatgacattcttcagacttcatagtcccctttcaataaattttactgggttcaaagcccacattacactttagcaccctttttgttaagaaaaaaatagctagttcaaaaatgaagaggtacagggcaagaagccgttagtttgtcaaaacctaagttaaataacaaaaatacgaacactgctttatacctagtaagttccacatcaatcaaattactatgagcacaaagactggagttaaaaaaaattatcaacactatatttaaaaagtttattagaagaaggaaaacaaggaaagaactagtcagctagctccaggtagaaaaataaggcaatactagaaatatttaatgttcttcacaacaagtgaagtatctccaaa

SEQ ID NO: 259351 - DNA, 415 bp, Homo sapiens
gctaccaaagagaaagatgttgtaatcacatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaagtcgttacagagaattgtttcacaaaacttatatttcatgtcaattgtatttattttaataatagctcacaatgcctttagtaagtaataaagtctcttattaga

SEQ ID NO: 259352 - DNA, 176 bp, Homo sapiens
catgttttttatcaccaagacagctggtattgtttacaacatatgtctgagtattatttttaagtttctaattgccagtatctccagtttttaaaaggacacaaaccaacctctttgtaaaacttctgccctccaaaggctttatgttctctaagatagttaagaagattaaaaaa

SEQ ID NO: 259353 - DNA, 599 bp, Homo sapiens
agtccctttaaacacatgcatttattaataccccaccttgtttcagaaaggatttaggatgtcaggaagttacttaatatcagggcttcagtttcctcacctctaaatgagagatttcatccaggtgatctaaattccttacagctctaatgttttgtgacctctgattccaatgatttgttggtcatctgcacttagaaatcctgctaacacttagtatgtagattatgaaaaactaaaagaaaaaaatctgaacctataaccctgttctcctaatgtgatttcttttaatggcatcaccatcctactaccagtgacccagggccaaaacttggtgtcattttcaactcctctagcccttgcccctacatctcacttaactgagtcatatggaactaactatgtaatgtcattcccatccttccccaactaggccctttcgtatggcctcatgtgattgaagcccttgctgactggctgtcccattctgttgacccttaatcttgatgctgctgagtcaatttcttgaagcacaaccgtaacaatgccaatgctttgttctattttatttatttatttatttttgagatggagtctca

SEQ ID NO: 259354 - DNA, 223 bp, Homo sapiens
catatgtcaagggcgacccaatgtttgcttcctgttccctaggtgggttttccatggggactgcttctaacccccaatccccacacactccacctgggctgaaactgctgcctcttttccaatatatagaaagaaatgtggctccaccctgcatttccgtaagactcagctagttacaaatttagaaccttggaaacaatgataaaacattcttcaagagaaa

SEQ ID NO: 259355 - DNA, 398 bp, Homo sapiens
caaagagcaagccagggtgggcctcttaaagcacaggtttcttgagtggtcccagaggtaacacaccccacatggtctcactctgcctctaggggaggcacttcagaacccactgttaatcaggacaaaggatccctccgtggaacaattctggggagctgcattcccaagaacagcagattaaaaatcaaatccgggaaaggagctaaaaccttgcgtgctgcaagatataactcatgtgtacgtgtttgtgaatggcgtgtggggatggtgcatggggatggtgtagatgaggggatggatggacctatgaaaagctcagagatctatcagagcaagcctgggcaaaatagcgagactccatctctaccaaaagaaaaaaattagccagatgtagc

SEQ ID NO: 259356 - DNA, 1039 bp, Homo sapiens
ccacagctgccgcccgggtagcttcccgcagacgccgtaggtagcacgcgatggaacgcggcggaggggagcgtggacacggctgccgggcgctgcggccatcggcgccctggacgcccgctccggccttcggggccggatatccccactctcgcgggctctttcgcgtggacccctcctccggccgacactcacactgcggtgaacgccagtcagctggcgtgaaataaggtcgctgggaaggcaccaagtcaccaaggtgggggatggccaggtcgtggtagttgcgacaaagaaaaatataagtcacattgcatttgtttctcgcccacccaccgctcccggcgtctcttcccgggctccttgccagcgtgccgaggcgcaggcagggtgatggaggctccccggccgggaggatctgccggggagagcggcttccctcatcgattcgggagcgccaggcccggcgcgcccgggctcctgtgacctgcgagcccgcgaattccagcggcataagataaggagcggcgagggcccaacaggactgaggtcagccagctataaatacgcctccagctccaccgcgggctcacgctggtgacctcgtgtaccctccggaggctcattccgtccatttggaaaatgcaaataattgtcaccacctcttttcttccatttcccctcattcatggtggaaaatgcttttaaaagtattcgatgacccgtatgtgaggaaagaggagataggcccctttttcaccaaatgtgactttaacctccttagtaatccaagaaatgtatcaagtttaagtcacttaacaaaagatgttcttttaaaggtgcattttaaaaaatcacttttaaaactgggtaaactgggtaaaaagaaagggggaaggaaaacaatgtgccaggcatttgtattgacacacattcttgcctgaagaggtgtttagattccagggtattcccttatattctggtataaatgtttgaattcccgtgtattttgtttcaattttttggtttatcttttatt

SEQ ID NO: 259357 - DNA, 738 bp, Homo sapiens
ccacagctgccgcccgggtagcttcccgcagacgccgtaggtagcacgcgatggaacgcggcggaggggagcgtggacacggctgccgggcgctgcggccatcggcgccctggacgcccgctccggccttcggggccggatatccccactctcgcgggctctttcgcgtggacccctcctccggccgacactcacactgcggtgaacgccagtcagctggcgtgaaataaggtcgctgggaaggcaccaagtcaccaaggtgggggatggccaggtcgtggtagttgcgacaaagaaaaatataagtcacattgcatttgtttctcgcccacccaccgctcccggcgtctcttcccgggctccttgccagcgtgccgaggcgcaggcagggtgatggaggctccccggccgggaggatctgccggggagagcggcttccctcatcgattcgggagcgccaggcccggcgcgcccgggctcctgtgacctgcgagcccgcgaattccagcggcataagataaggagcggcgagggcccaacaggactgagctctttccgaagtctgattcaggtgcctgaaaatcaacctatggccaccaagcctatttgagcatggagggtactgggggagacgtacataagtgagcagtcacaaagtaggcgcgtgaaaactttccatggccaccaaacggaacctgggggaacaagcttcacattggctttaacgcgaaaagccct

SEQ ID NO: 259358 - DNA, 4280 bp, Homo sapiens
  misc_feature (1458)..(1458): n is a, c, g, or t
actcactataggggctcgagcggccgcccggggcaggtcttttaactctccacagtggagtccattatttcctctggcttcctcaaattcatattcacagggtcgttggctgtgggttgcaattaccatgtctgactcagtaattcttcgaagtataaagaaatttggagaggagaatgatggttttgagtcagataaatcatataataatgataagaaatcaaggttacaagatgagaagaaaggtgatggcgttagagttggcttctttcaattgtttcggttttcttcatcaactgacatttggctgatgtttgtgggaagtttgtgtgcatttctccatggaatagcccagccaggcgtgctactcatttttggcacaatgacagatgtttttattgactacgacgttgagttacaagaactccagattccaggaaaagcatgtgtgaataacaccattgtatggactaacagttccctcaaccagaacatgacaaatggaacacgttgtgggttgctgaacatcgagagcgaaatgatcaaatttgccagttactatgctggaattgctgtcgcagtacttatcacaggatatattcaaatatgcttttgggtcattgccgcagctcgtcagatacagaaaatgagaaaattttactttaggagaataatgagaatggaaatagggtggtttgactgcaattcagtgggggagctgaatacaagattctctgatgatattaataaaatcaatgatgccatagctgaccaaatggcccttttcattcagcgcatgacctcgaccatctgtggtttcctgttgggatttttcaggggttggaaactgaccttggttattatttctgtcagccctctcattgggattggagcagccaccattggtctgagtgtgtccaagtttacggactatgagctgaaggcctatgccaaagcaggggtggtggctgatgaagtcatttcatcaatgagaacagtggctgcttttggtggtgagaaaagagaggttgaaaggtatgagaaaaatcttgtgttcgcccagcgttggggaattagaaaaggaatagtgatgggattctttactggattcgtgtggtgtctcatctttttgtgttatgcactggccttctggtacggctccacacttgtcctggatgaaggagaatatacaccaggaacccttgtccagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtgaaattgaattccataatgtgaccttccattatccttccagaccagaggtgaagattctaaatgacctcaacatggncattaaaccaggggaaatgacagctctggtaggacccagtggagctggaaaaagtacagcactgcaactcattcagcgattctatgacccctgtgaaggaatggtgaccgtggatggccatgacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacagcaatttgacacccttgttggagaaggaggaggccagatgagtggtggccagaaacaaagggtagctatcgccagagccctcatccgaaatcccaagattctgcttttggacatggccacctcagctctggacaatgagagtgaagccatggtgcaagaagtgctgagtaagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaaggatgcaactgaagatgacatgcttgcgaggacctttagcagagggagctaccaggatagtttaagggcttccatccggcaacgctccaagtctcagctttcttacctggtgcacgaacctccattagctgttgtagatcataagtctacctatgaagaagatagaaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttgggactttttcaattcctgataaagaggaacaaaggtcacagatcaatggtgtgtgcctactttttgtagcaatgggctgtgtatctcttttcacccaatttctacagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcgacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtgatgatagatggtcatgacagcaaaaaagtaaatgtccagttcctccgctcaaacattggaattgtttcccaggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttactttaaagaaaaaacaatcccagcaacctgcccgggcggcgctcgagccctatagtgagt

SEQ ID NO: 259359 - DNA, 393 bp, Homo sapiens
cgaggttggaaaaggttgtgaaaccttttaactctccacagtggagtccattatttcctctggcttcctcaaattcatattcacaggtaagtaacttatacttgtctctgcaaatccattccctcttccctttaactcttactttgtggagtggagtgtttctggtttattaaacattggtctcttgtccagtgtaaacaacgctacaatacttggatagaaacttacaggatgcattaatgatttcacaacattgtatacaatacagatgactcttggttgctgtcttctttatagcaatgctatttcatgtatcaatctcttagagagagagagagtggtgtacatgggtgtgtggtacaaatggccgaatagattgaataatctgctcaa

SEQ ID NO: 259360 - DNA, 1363 bp, Homo sapiens
actcactataggggctcgagcggccgcccggggcaggtcttttaactctccacagtggagtccattatttcctctggcttcctcaaattcatattcacagggtcgttggctgtgggttgcaattaccatgtctgactcagtaattcttcgaagtataaagaaatttggagaggagaatgatggttttgagtcagataaatcatataataatgataagaaatcaaggttacaagatgagaagaaaggtgatggcgttagagttggcttctttcaattgtttcggttttcttcatcaactgacatttggctgatgtttgtgggaagtttgtgtgcatttctccatggaatagcccagccaggcgtgctactcatttttggcacaatgacagatgtttttattgactacgacgttgagttacaagaactccagattccaggaaaagcatgtgtgaataacaccattgtatggactaacagttccctcaaccagaacatgacaaatggaacacgttgtgggttgctgaacatcgagagcgaaatgatcaaatttgccagttactatgctggaattgctgtcgcagtacttatcacaggatatattcaaatatgcttttgggtcattgccgcagctcgtcagatacagaaaatgagaaaattttactttaggagaataatgagaatggaaatagggtggtttgactgcaattcagtgggggagctgaatacaagattctctgatgatattaataaaatcaatgatgccatagctgaccaaatggcccttttcattcagcgcatgacctcgaccatctgtggtttcctgttgggatttttcaggggttggaaactgaccttggttattatttctgtcagccctctcattgggattggagcagccaccattggtctgagtgtgtccaagtttacggactatgagctgaaggcctatgccaaagcaggggtggtggctgatgaagtcatttcatcaatgagaacagtggctgcttttggtggtgagaaaagagaggttgaaaggtatgagaaaaatcttgtgttcgcccagcgttggggaattagaaaaggaatagtgatgggattctttactggattcgtgtggtgtctcatctttttgtgttatgcactggccttctggtacggctccacacttgtcctggatgaaggagaatatacaccaggaacccttgtccagattttcctcagtgtcatagtaggagctttaaatcttggcaatgcctctccttgtttggaagcctttgcaactggacgtgcagcagccaccagcatttttgagacaatagacagggtatgtataagccaaaagtaaaggccattaacaggtggg

SEQ ID NO: 259361 - DNA, 913 bp, Homo sapiens
agcgggccagggagtgatcccagcagagagaggctgggcatgaagggatggggtgatgatatgtcaattaggcttcagctcctgctccagggccctttcatggaggcttatttcctaggtcctctcccaaggacaccctctccatgctctcaaccgcatcctcccctgagtctcacggtcagactacagtctatggcctacatcttccctctccccgagtcccaaccccagctttctcagttcctggctgcaatggtcctaggccccccactcaatttccaaaccttttgcctggtgccaccttctctacccagaactttggcctacctgtcagtcctgccctgcgtgtcacctcagcctggaagtccataggactgtgatgaagatgactgcttgcattttctgaatcactttgtcgatgagacatgcatcctattagatctaacaaagcttcacagaaaggttgttttgaagttgacactgaggaagatataagtgctctaggatcagtatgtgaggctgccacaaacatgctatagtctgcacattcttgcagagaggttgcagagtctgcttgggagagaagcctcaaaaacatggctggtgtcttggcagagtttgctctggcccccaggagggtgtacaaacagccttcatgagaaggtgacttgctggccactcttaaccactagaagaaactgatgccatggaactttgaaaaatcagaaagcaattccacaaaagaagaacctctgaagatagtagagcccaatgaagataaatgacatcgcccataggagggaacagtggtatcaacctaaaggggctcactgccctatgtgctggaggccaatactatgacaatgggtttttgagaaaataaaagctttgcattgagattcaacccctaaaa

SEQ ID NO: 259362 - DNA, 459 bp, Homo sapiens
acaagcagccagcaatggatatccagggcatggtgtctggaatcactccgggctatcctgacctatgcttcctggcagcctatctgttaccttctatttttgtggaggaagtatctcgagtgggcatgagatggaccacgggagacatatttgacagtgaatctgcacttttgcctttcagagaggcataaaagcacacacgagttatagaaaatgcaggagtattatctccccctctcattaagctgtcatccgcttcggtgcagatctgtctcttggttttgaatctcactttcccccacttctggctctccttggagtatttttgatctcatgcagccacctttatgatagatgaatcattcctatgtcaaccatagtcatcatgaatcctctgagtgagctggcaagagaaaatcgcttttaagagaacagacctcctaggggccacgggtggtt

SEQ ID NO: 259363 - DNA, 496 bp, Homo sapiens
ggaaaagtaagaaaaggatttacagtaactatactaaaactatatataaatgtataaactacattttaatgaatctatacgaagaataaaatttctaagaagaaagcaactgaaaagaaaatttttatttacctcattcttttttaaatgaaagaaacagcctgggggtaaagattctgttgacagacaatcatgctggccccagatttcaggacctttgtaacaggtctctatactaaattacctctattgaactaccttgtgagggctctatttttctgactggatgctgattaacggtagtatttttcttctaagtagtactcctgaatagcaaaaattagatgtgcaaaatcattctacatattgcataccgagcacttttctctctctgtcttctgtgtgttcaagcatagtcagcacactcctttgtgcaacgtgtgcccctctcatcttccaccagctatcctcagccagaaaccaggtggctctggcc

SEQ ID NO: 259364 - DNA, 382 bp, Homo sapiens
aaaatatttattacctgcagtgcttaaatttaaagggtaaaattaattaaagaaatcctcacattagaattacatgtaatataattatatgtaataaacctaattatattacatataatgcatgatcctctacgaatttaatttgaatgtgaagatttctctaattgcatatatataaacatacacctacagttttatgtgagagaacaattctgtcttacacattatatgatttcacacctttgaggatagattgctagataaaagagataggaaaaaatatttagcagtttcatagttcattggggtcaagaagaaagaggagtgtggcaagttcattttcttcttacaattacaacatcagagaagaaatgaagtaaaa

SEQ ID NO: 259365 - DNA, 383 bp, Homo sapiens
accctaggttccagaccggcccagaactagattggctcacaccaatccaggattcaggcccaccccatttccaggttggcagccctagccctaggccttagtcaggtatctggcaagcatctgcagacccaggctccaggcctcccgaggcctaagccagtttctgccaccccactctccaggccagttcctatggtcccatcctccagcagacccagggtccaggcccatcacagttgactccagtattgggcaggtgcctacagacccagtatctagtactgcctctgtggacttaggttccagtccagttcctacagccctaggacccaagccaccctttgtggccctagtgtccatgcccacttctgaatatgttggtt

SEQ ID NO: 259366 - DNA, 1983 bp, Homo sapiens
ctgctgcttcgcggcggtggctttgtgccacttttcccagggcttgggcatcattctggacccatgttcggtgaaccggttactctcagagctgctttcgggcgcagctcctgctgcagccagggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaagtccaagcaatgtgacatccgtatttcacaatatttctggtgtatcagttttgtatgttacatttccattttgggattctgctttatgatactttactttcttacattttgcatttttgttctgtaaaagatcactgccaataaactgcaaaagaccaataaattgcatatcttcagaaggatttcacattttaaatcgtgcctttaaaactgctttttccccccacatagaatccattttagagttagaaaagtgttctttccaagtgttaatagtttgtcttgcagatggtaccattttatgtcaccaatatttaatatgagaaaaaacaacctgtttaaaaaccttgttttgtatatcagttatgaaaatatctggtagttggaaatctctttaatattcattttaaaagaggaaagggcatcttttccggggggaagctatattttattaatcagaaaaatactaaacaaatgtgtttgtagggaatattgagagtgaaaaacaattgttgaatgggacataagccaaaaagacaatgctttttattatttacagaacgtaattcttta

SEQ ID NO: 259367 - DNA, 2125 bp, Homo sapiens
ggcagcctggagtcaggggagcctggggaccacggccttggtcagctctgcacgatcagggctgaatcaggaagtggcagatctagcaacaaagtccagattcctgaccgatattccttctccacatgccagtccttttccaaatcccctcaccttaaagtgacaaatgagctttttagtgaaaaagaatgagcgctgcattcttctaccaattttttggagcccagaatgggggggaaaaaagtcttcttaatttttcttaatacctaccatgtcccttcttaaataactcaagagcttctggatgataatggtgactttatctccttttcctgcagatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagacttgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaaccagcgactcagttatttcaaaacaccaagaaaataagattagaagacacaaatcaagaaaactttacaaggattgaagggactggcacaggatctctttctgggaaagccttgggttcagtggtatatgtcaaagaaagtgatggactagaaatgacagatgtggaatgaagcaatttgtacgtattaccaaagaaaccaaaaactgcctttgactaaggggggtgttgaaagagaacttaaccttattaggaaaccctgacaaaatgatggaagactattgccttattttgcactatttgtgaatcatcttacactgcatttttttatgatgcttattcaaaaggcagttgctttagggtgaaaaagccttccaagattcaaagcagatttctctggtattatattatatccttcttaaaaaccagagtttttaagtaacagtatttgaatggcatcaaaacattttcattttaatgtatttctttaacaagtggttaaaaaaagtgtccaagcagccgggcgcagtggctcacacctgtaatcccagcactttgggaggccaaggcgggtcaatcacctgaggtcaggagttcgcaaccagcctggccaatatggtgagaccccatctctactaaaaatgcaaaaagttagccaggcatggtggtgggcacctgtgatcccagctacctgggaggctgaggaaggagaatcgcttgaaccctggaggcggaggctgcactgagctgaggtcatgccattgtactccagcctgggcaacaagagcaaaactccgtctcaaaaaaaaaaaaaaaaaaaaaaaagtccaagcaatgtgacatccgtatttcacaatatttctggtgtatcagttttgtatgttacatttccattttgggattctgctttatgatactttactttcttacattttgcatttttgttctgtaaaagatcactgccaataaactgcaaaagaccaataaattgcatatcttcagaaggatttcacattttaaatcgtgcctttaaaactgctttttccccccacatagaatccattttagagttagaaaagtgttctttccaagtgttaatagtttgtcttgcagatggtaccattttatgtcaccaatatttaatatgagaaaaaacaacctgtttaaaaaccttgttttgtatatcagttatgaaaatatctggtagttggaaatctctttaatattcattttaaaagaggaaagggcatcttttccggggggaagctatattttattaatcagaaaaatactaaacaaatgtgtttgtagggaatattgagagtgaaaaacaattgttgaatgggacataagccaaaaagacaatgctttttattatttacagaacgtaattcttta

SEQ ID NO: 259368 - DNA, 888 bp, Homo sapiens
gagccagaaccgattctggaacagcttctcccgcccccgggccagagagggttccccagcccctggaaagccaggacaccccctaggctgtcccagcacgcctcagcctcaggtcctgagccaacatctctctgcgctgcctgtgaatccagactgtgactccagactgagggccaaaccgagaccactccctccaccgtcagttggccataattgtcagggtgacctccccgaccgaccgtctccaccgaccgtctcctccagacagcagcccacagaacagccaccgaccaaactgccttgcccatgagacaggagcaaaaccagcttagaaaactttcccactgttggagtaaaacccagaattctcccagaaaggagaagcataaggaactttgaatttatcttttatactttaaaagcagcagaacttgagacattcattcctcggagctttgttgaagaattgaggaaggggtgcttaataatcccattcaagaatagttcctctggaagggagagaaaactcagaaatccctgagtactgtgatactccaaaatgggaaggcctggaaaaacctaggtcattaaaaactgaagcttaaatttctacattgcttaattttgtctcaactgcacaagccaacagagtgtgagaaatctctctgcgtgccagcctcccttttcgtcacacaactctggaaacagttataggaagattgcagcaacaaattgtaaacaaaaccaggtcaagaaacagaggagagggccaggcagggtggctcaggcctataatcccagcactttgggcagctgaggcaggtggatcacctgaagtcaggagttcaagaccagcctgggcaacatggcgaaacctcctctctaatt

SEQ ID NO: 259369 - DNA, 468 bp, Homo sapiens
attatttagtttcaaatagaatttaaagggaagaagtatgaaggatagtgacttaaagtacacagaaactgttgtacagttttgaacacccaggttacacactttattcaaatgctggtagcctcttttaggtgtgtgttttcttttccaaagccatatctaaatgcttacttacataaacacgtgagtcacctctgcattctggggagttttaacgttgctcatttttgccacaataggaagaagtgtcttggtttggatggttctgtcgtggaaaatgggtccgcaagaaatgcttgttgaatgaatgatgatatctcccttttaatagctgggaaaaccaaggcaaaaagtcatggccggaggaccacacttcacttcctctgcttctctttctgggtctattgcatatataaataatttgggggcaataaaggattggaattttatgtgtactatcagatgcca

SEQ ID NO: 259370 - DNA, 621 bp, Homo sapiens
gtacagcaagggccaggcgtggtggctcacgcctgtaatcccagcactgggtgactgaggtgggtggatcatttgaggtcaggagttccagaccagcctggctaacatggtgaaaacccacctctactaaaaatacaaaaattagctgggcatggtggcaggcgcctgtaatcccagctatttgggaggctgagacaggagaattgcttgaatgtggaggcagaggttgcagtgagccgagatctcaccactgcactccagcaaaaaaaaaaaaaaaaaaaaaaaaaaaaaaaatacagcaaaattgcaatactttaatgcagagaaattcacatggtggaagccacatgaaatctagctaaaggaaattctagaatgctaggtacagatcagtgcaagcagaagtcactatctgctcctgtctaaagagacaaaccctgtctctactaaaatcacaaaaattagccgggtgtggtggcatgcgcctgtaatcccagctactcaagaggctgagatgggagactcacttgaacccgggaggcggaggttgcagtgagccgagattgcaccactgcactccagcctgggaaacagagcgagactccatctcaaaaaaaagaa

SEQ ID NO: 259371 - DNA, 256 bp, Homo sapiens
aacaaccaaaaccatcttccaggaaagacacctatttgcctggattcagtcctgaacatatgtaccacccaactgtagtcacaaagaggaattctgtttatagaaaactattgttaatatttttaaaccatttgctacattactatattttaaaagcttaaaatttcacagagaaaaataattttaccttttggaattactacattttggaattacaaaattttgccgaaaaattcttaagacagctgagtctgca

SEQ ID NO: 259372 - DNA, 169 bp, Homo sapiens
tgaccccacccctttttcttttgaggacaagaaggcttcaaaattaagccaatctgctatttgtagatttggagaatgttctcccctttcagattttcaggtttcaagttgcatccaaaagagaagagactcagtcctcctctccactgacagaatacgacctcaacat

SEQ ID NO: 259373 - DNA, 701 bp, Homo sapiens
gatagtttagcctgaacaacacactctctgtctagagactcagccagctatgctttcgctgagtgaagggctccactaacacatccctgactgacgctataaggctggccaggttctgggcctcaggaatcaccacccagtctgtgcaaggcttgggatgagaagcgaatcactccaggaggctcagttaatggcagagtcaggcctcaaatacaggtttcctgatgtctaaacctgggccctttcaaaagcccccaaacccagggaggactggtcttgatcatgagctccttaaggttttttgcttgctgtagaagtttaccgtaaaatgttacctcagaaatacaggatgtacttctcaggggattagggggacatccaggggtcttggggtctctggctgtgcccaggaacactgctcagtgaggattggtcccagccatggagggtgctggtgcccagaaatttagagtggctgtggctaagtgacccatatgcttttcatggactgtttcttacccttataacaacctaagagccaggtatgaattgtccattttatggatgaagccataagacctagagaggttaggtcaactattgaagactcaggtttgtctgactccaaagcccaaggaactctttttcaccactccatacacgtagacaaccctgtgtgaaagcttggctctggagaacag

SEQ ID NO: 259374 - DNA, 404 bp, Homo sapiens
aaatctctttaacattgatcctgttgttagttgtaatctcagtatattctgataatttcctttgaatatgtaactgttcctttcatactgtgggcatctgttgtcttctctttttatagcaatgaaagtatgaacagattccaatgtgggttcttagctcaaaattctctggctctaatgtcaggccaatttatttagctagtttatacaactggacatatttctataatagaaaaatgactaaatgtttcttaacatattgtttacagagatagagcccatgttgtaaggctatgtaactcttcctctcaaaagaagattattggttttagcatgttttcctccctttaatttaatcttaagcaggtgaacctttttgagggctttttggaaagctctgagga

SEQ ID NO: 259375 - DNA, 447 bp, Homo sapiens
agaaaataaaattacaaatatacagaacatacataatgagattctatttggttcacattttaacattacctttctacaccatctgcctctggattttcaataagacatcttttggtttgtaaatcttcgtctttgccaaaagacagtttctagaggttcagaaagttgtcacactaatacagtcacaaaatgaagcagcatggagcagcttaggaggacacaggagagtgggtgttttattacatttccgtcccagatcattgtttctaggaggtaattcataaatttttaattcttctagtgttcttgagcaatgtaaaaaggaccactcctcacccagttcaacctcttttatcacagtagttgcaacaattttattatgcaagattggttattctattatcttgatgcttatttaatagcaaagcataatttatgcccttctct

SEQ ID NO: 259376 - DNA, 647 bp, Homo sapiens
gtttatatctggaattatccatttaatacatttggactactgttactgccggtagctgaaaccatgcaatgcaaaaccatggatgaggagaaactaatatataagcaaatattttaaaacttactcactaatagtgttttttcatatcttttctataaaattttctgttcttcccaatatcttcatttcaaccaatgtggcaatatcattctccagataatctgatctccctgacctgagcgaactttcattctgtcccttttcctccccagttcccatcagccaatatatgctatagatttcttatatcatacctgtttcatccattttttcatttctacctcttctcctccaaatatatttttggatactttgtttttttgaaagtttattctaactctcatactttaaatccatctaatacataccattcacgccacattcacgccattttctctgttcagatgtttaaatagaacccagttgcctaggataaagctgaaatcattatcctgatattctagactctccacaagctgattctattgctgaaaggaagtgatccttccttccttcttccctccttcagtaaatgtttatggtgcacctagtatatgccaggcactgtgctagtcagtggagattca

SEQ ID NO: 259377 - DNA, 347 bp, Homo sapiens
acactgtccgtctttgcactgaaggaagaacacggtggcacaacccagtgtcttcactgcgccacacggacaaaggacacctctgtcacaggccggcacagctccctgggcaaaagtgacacgaccatgttattactccctagtcaagcccacgggaaagaaaaatgcctccctggagtttctgcaacacagccccctgttctctaccactactgcccgctccaccgcaggcctgccccgtcttcctcctcctccgggcactaggatccttgcagtggactcttttcaggttaaaactgaggatggacagcaagcagttagtcattacttgctatataaaaaggatt

SEQ ID NO: 259378 - DNA, 779 bp, Homo sapiens
aggtgtgcgccaccatgcctggccattttctgtgtttttgaaacacacatttacttatttaatgaaaatagaacatcatatactaagatatttcagcatagttttgttccacttagaaaaagttatggcaattttatcagtaactgtctaacttaatacccatacatgatgcaggataggtgtgtccccaaattggggcttaacctgggagggttcttggcttcacttaggatggagttcaagggtgagccagtggtgttaaacagtgactttgattgaagtggcagtgtacagcagtggcagaggggctgttccttgtggctaccccataggcagtgtgcccacaatggcagctctggttctacagtcatatttataccactttgagttacagacagattaaggggcagagtatgcagtaatttctagaaaaaggattgtagcttctgtgtctttgggttgttgccatgggaagggcagtaacttccatgcgttgccgtggcagtggtaacctgacataaatatgctgaggcaagtctccctttaatttttcattttcaagctattttaaactatttttaaaccttttttcacatgtttattcttccagatatattttattaccatttttgtgtcattttctaaaaaccttttttatttcatttggaatttaatttagtctatgttttatttagagaattgaactcttcgtaagattactttttttcctacaggaacatgatgtgtatctattttcttggttcttctttcaatctttt

SEQ ID NO: 259379 - DNA, 474 bp, Homo sapiens
gtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctattta

SEQ ID NO: 259380 - DNA, 304 bp, Homo sapiens
caactcccaaacccatcatctctggcagaattcttgcaatagttctctctcttatttaaacaattcagtggttttttagtgcacagtcatttgccatatgttgacatttcaggaaatgacagaccatgtacatgatagtggtcccataagattataacactgtatttttactgtaccatttctaagtttagatacacaaatacttaccattgtatcacaattgcctacagtattcagtacagtatcatgttgtataggtctgtaggagctataggagcaacagggtataccatatagcctaagt

SEQ ID NO: 259381 - DNA, 984 bp, Homo sapiens
gggaagagaagaagaggaaccagatctttttgtggacagctcttttgcaaagccgtccggcctgaatattcagtctgacataatgacttacattcataaattctaaaatgttaaatatttaaaagaaatattttctcagaaacataactatgtttcttcaacttgtgtcctggtagaagttttttaaggagcaaggaaggagtaatgaagagagaagcatgatttattattaactgctattgtgtaaatgcatacctctaaagtattgaaaataatcttgttatgttaatcttatggttataccacttacagtctgcaatttatgattacactatgaatttgctctaagaggaagaagtttacaaagtaaaagtaaacttcaatgaagcattttataaggtttgtcaaaataagtgagattttattgtacaaaccagaaaaatataagtttcattttacccagaattgtggatgtgtttttaggtgaatacttgtaatgaagtttatgaattaaagaagaaagtcatagaaaggctggaggacctttgcaagaatgtggaactgctgagtgcaaagctaaggatgtatcaaatggaggcagaggacactgactctcacagttctgaggaaatagatacggaagagatggaggccctgcttcctcaggccccagcatcctttttagtgcagaagtctcctccccgcaatacagcatggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgtattgtg

SEQ ID NO: 259382 - DNA, 310 bp, Homo sapiens
ttttcagaatttggttaacacagatgttttctctctttgtaggaaacgtgcactgaggattttcatcatgtttgatgtcctcaccgtcactggacttttatgttacatactattttttggtgctacatttctctttgaaagggtgcttctgagaatgcttgggtgccgcaccacatgggacctacgggagatgagagagcctttcttgaatttggaagtggaagccttgttaccctcctaaagatacagaagttactgtcaccctactgactttctcaccagtaaacattgtggctgttcctgtattgtg

SEQ ID NO: 259383 - DNA, 688 bp, Homo sapiens
  misc_feature (1)..(1): n is a, c, g, or t
ncaaatgtaattattcgctctcgccaagctctcatagatgcgctcttattggaaaactcaaatcattttctatgaacatgtaaatttgatatttacactgtaagatcagcattaaagctattctatagcgttgtagagttgtgctgtccaatatggtagccattaggcattaggtcgagcccttgaaaggtggctagtccaagttgagacatgccataagtgtaaaatacatactagaattcaaatactgtgtgtgaaaataatgtaaatgatctcagtatgtttatattgattacatgctcaaataacatttttgacatattatgttcaataaatttattactaaaattaattttacctgtctttaccttttgatgtagcttaagaaaacataaaattacatatatgacttgcatttgtgatctgcactacatttctatcaggcagttctgcttacagtttaaaaatttgtaggtgggactgccccctttctgtctcgtactccaatttgacttaaacaaaaaaattggcgtttttaaaacaaagcttccttgtatggaaaagaactcttatgggtaaaaaaactgaaaatcagagaaggtaagtggcagagctggtaatttaacattacatttcaatatcccatactgagagtcaagtctatacacatgtatgtatatatatatgt

SEQ ID NO: 259384 - DNA, 126 bp, Homo sapiens
tttgtctaccaatatgacttcaagattatctacagatgtgcatttagctttagaaattcagtttttaaatcatctggtaggttggaagtatgtggttgaatacttgtggttttctttcagtataat

SEQ ID NO: 259385 - DNA, 315 bp, Homo sapiens
ctgctgataagaacagttggcctgtggtagagaagggaggtcaaggggaagagtgaaggtcactttcataatattatcatcaactaggagatacataaaaataatactggtcataatctttacaggatgaaatcgagaatctccaatgaaatattaaattggccatattctataatgtaacagcctgttggcatttttatgcccaatcaagtgggcatttttatccatatacagtgttatgcattccctggaatatatttgaataaggatgattgaacagctttatgatgaagaaacactaaatacattgactat

SEQ ID NO: 259386 - DNA, 396 bp, Homo sapiens
tcacagacacaaggcccggagccatgttgtccctttgctcctacaaaggaaacaggatgcccaaaacaggacttgtaaatcccaactcaaaacctccccgttccgcagggacacagggtgctttgctccttgaaggagtagtggatgcctccttatttacatccttcgtgcttacaaggcagtgggggtgtccaggggacatcagccaccctgtgctggggcacttcagaggctccggggagctgccatgctctctctccatcccaaaagatgggtctggggaggccactggggcaggcgagcccgctcctgtgaggagtgaaccccaccccccgccgctctgctggtgtgagtgacagttatcaacagaccctgaatgggggcttcccagaaaag

SEQ ID NO: 259387 - DNA, 598 bp, Homo sapiens
gacattgtttcacttaatcctcataacagccttatgaggtaggcactattattattcctattttagagggaagaaaacaaacaaggagttacattgctttattcaagacccctcagctggagccaggtttccatcccagcctgttgcttctagctccttcagtggactacctgcctaagggatggtggggggtgggggaaggaatggcacagagccagggaggactttatcaaaagacacccaccctctcacccaagcactggcattaagaacccaggggaaagccaagtctaatatcagggctctccaggccttcctctttgcaacagcagttagcagattttcctagtgggttacagtgcttggctttagatatgacacccacctcttcatgggctgtaggacaagaacaaagtgtgtttacatatgctcttcccactaaggtaaaccaaggaattggtttataatggaggatttgctgcagaaatgctactgggggctctgcctgagacacacattcatgcaatatttcttcagaatccctgaactgcaagtttgggattaaggtgctaccatccagtagaggaaaggaagctca

SEQ ID NO: 259388 - DNA, 601 bp, Homo sapiens
aatttgcatttcattggaatgtatgtgttttcactaaattgattatttatgttatactcccttccagtgatccttaaaaatgttcatgcactgagaatcaccaatgaacagagatggaagggagcttagagatcatccaacctgacctcctttacttttacagatggagaaactgaggagctgagaggttaaatcccaggcactcaagaagtacctgtgaaatgtgaggccagatggaattttccttctgctccaaagtcctggcagggtgggaatcttcagtgggacagggagccacagaggctttgctagcaatgaggggatggccaccgtgaaggaagggtgccctggtccaggatggaggtaggacccacctgtgcctctaaggataaccgtcaccaacccaaacccgatgggagcatctctaagatgaagtagagtccaagtggggaagacagggggacagaaaggtccagagactcagagaactttgggacagggagaggatggtgcagaccctccagcaagagactcagggacccccagctgttccctgaaggagtcctggtgtgggttgaaaggtgacttgaagggaaaaggg

SEQ ID NO: 259389 - DNA, 466 bp, Homo sapiens
gagctcttgtttctgagactgttcttcctgcattcagatttgggtacagcaggggattgaagaagcaattttcagattccatggtgggctggattaaattactccacaggccatatgtctcacagacctactagagtggattaagtgttttgctttctgtttgcatttgaatattttcataaaagaaagaaaatgttaatgcaggcctagtaaaggagaaagagacgaacaaacaaattcaggtggcaaagaagcctcctagatatttcctgttggtgcatgacagccaggactagatggatttgaagatgaaaaggttgaagcaggacattctgcttggatttcattaactattaacatacgttctatcaaggacaaagagtaagcattaggcttttgtctgtttgtttttaacacctttccagagcttgttgatacagattgctgaaatttaaaaataaaaaaa

SEQ ID NO: 259390 - DNA, 2014 bp, Homo sapiens
  misc_feature (46)..(46): n is a, c, g, or t
  misc_feature (126)..(126): n is a, c, g, or t
  misc_feature (170)..(170): n is a, c, g, or t
  misc_feature (249)..(249): n is a, c, g, or t
  misc_feature (261)..(261): n is a, c, g, or t
  misc_feature (354)..(354): n is a, c, g, or t
  misc_feature (944)..(944): n is a, c, g, or t
  misc_feature (1164)..(1164): n is a, c, g, or t
  misc_feature (1239)..(1239): n is a, c, g, or t
  misc_feature (1640)..(1640): n is a, c, g, or t
  misc_feature (1674)..(1674): n is a, c, g, or t
  misc_feature (1696)..(1696): n is a, c, g, or t
  misc_feature (1709)..(1709): n is a, c, g, or t
atttacaaattagccaggtgtggtggtgtgcacctgtagtcccagntactcgggaggctgaggtaggaggattgcttgagcccaggaggttgaggctgcagggagccaaggtcataacatgcactncagggtgaatgtggtgagaacaccaggaaggaggaccttgcatngttttaccaaagctcagcacccccacccagccctggatgccacgccatcctgcttcccagggggctgccctgctccctntccgtggccttntagtgagttctccaggaagaaggctgaggctggcattttgaggaacacccaggtccagggtatattaaattccacttacatgtcctttaaatntttcttaatttttgtaatctagcttaacttctacaaatgctaattgtatgacacttcaccccaagcagcctggcctttccactgttaatgtcagtgcatgggggagtctgaagtgcagtcctggtgggggtgtctcaggaggaactgaggaaaagcttctgaggggtcccagggtttcaggccctcacaatgtgactgcatgaaactgcgattttggggaaaagccatggggcaggccaggcagggcagcccatgggagcacgtgggtttgagatcaggctcagccacatccagccgtgcaaacgtgggcaaggtcctttgccatcctgggtctctctcctcctctgggacatcaggaggatcctccccatgagagcgagggtggtgtatgtgggcacagctggggtttgccaggtggctgtcttcaccacataggtggtacacaggtgcccagagggcctctcccacatgtggaacattccctccaccactgcgcaggaggccaggcttaaataacacaaggggattcctgcactgaagcttccaccattctgagtggggggaccaggtaaggtgcagagagagacggnagggcctacctgtcaccagagcactctgaaaaggggaaaggtcaggaaagtgaggcagggctgagagttaggacacccccctggctggctaggcagaacagggagcctggtgctatgcctgaagtctggctaggacaccccacgccacctcatcccatctgaacctcagtttccttgcctgtaaaatgagggctaagtctctctacctcagaggatggcngccagatcgagtgagatggccccgtgacagccctctgcgaaggggatggcagggtgaggggagctcttatcgccnttcaccaccactgtcttggggctctctgcagccagagctgtggggtcatcacctgtccctcagtttcccaagatggccttgcagctccagcccctccatctctggctccctgcaactggagcagcccgagctccagtcatgaggtacaggaggggaggggaagggacagggctccctggaagggagctgctgagatggggataatcagtgtttctccagcagagactcaggggagaggcagggatctcagatcgcatgtctctgagggctcaggaactgcagtctgaatggaaagtcagtgatttcactcaacatgcttttcactctgtgctgggtgatgctgaagaagtgggaagaccaggtccctgaccttgggcagctccccttccaataggggagtntgtggaccagtcccctgagagaacatttacattntgctgaggggtaggtagagttntggtgaacagaantagttatgtagcctctctagcctcagtttccccactcaacggcagttgggggttgagagcattaatgcataaaaagtgcttggcctggtgaaaccctgtctctactaaaaaaaaaaaaaaaaaaaaaaaaaaaaaacactacaaaaaattagccgggtgtggtggcgggcgcctgtagtcccagctactcgggagcctgaggcaggagaatggcgtgaacccgggaggcggagcttgcagtgagccgagatggcgccattgcactccagcctgggcgacacagcgagacccagaaaaaaaaaaaa

SEQ ID NO: 259391 - DNA, 518 bp, Homo sapiens
  misc_feature (46)..(46): n is a, c, g, or t
  misc_feature (126)..(126): n is a, c, g, or t
  misc_feature (170)..(170): n is a, c, g, or t
  misc_feature (249)..(249): n is a, c, g, or t
  misc_feature (261)..(261): n is a, c, g, or t
  misc_feature (354)..(354): n is a, c, g, or t
atttacaaattagccaggtgtggtggtgtgcacctgtagtcccagntactcgggaggctgaggtaggaggattgcttgagcccaggaggttgaggctgcagggagccaaggtcataacatgcactncagggtgaatgtggtgagaacaccaggaaggaggaccttgcatngttttaccaaagctcagcacccccacccagccctggatgccacgccatcctgcttcccagggggctgccctgctccctntccgtggccttntagtgagttctccaggaagaaggctgaggctggcattttgaggaacacccaggtccagggtatattaaattccacttacatgtcctttaaatntttcttaatttttgtaatctagcttaacttctacaaatgctaattgtatgacacttcaccccaagcagcctggcctttccactgttaatgtcagtgcatgggggagtctgaagtgcagtcctggtgggagaggccctttgggcacctgtgtaccacctatgtgg

SEQ ID NO: 259392 - DNA, 707 bp, Homo sapiens
gttataatgaacataaacagcagctgaaaaaaataaccccacacttgatacttaggggatttgcctaaacacaaagaaaacaaatacctttatttttctcttctccacttccagatattattttaggtgacactacaggcagtgagaactgctataggattaatgcatcttaaagactttcttgcgttgaaaggaagatgaatcccaaatcctatagggtaaaatttggtgggagcaggtaaagagtctgtaggtttttgaagagctctgtccaaagttgaagggccgacattaagtcagggaacaaagctacacaaagaaagggtagggcttaaatatttttagctcctttcatttgaactaaggggatggtcacaacatcaattttgtatctttcttcttctatgttgtaacatccaccaatcatccccattccttgggcaaagatgattaaaaccacaggaagtcatgtggagatgttaaggatgtaccttcaggagaagactaaaatattaggcaataaaaaagaagtgtaacttttctaatacccccttctccagaggccagtgtacagacagatgcatcaagaaagcaatagtttccaaatactagttcccaaactatcaatgtgaaaaggagaccaagcagcactgagatatataaaaggagcacgagatggagagaagctgctgccaagatgacatctc

SEQ ID NO: 259393 - DNA, 597 bp, Homo sapiens
catatcaattcttagagtgtgatatgtgagattcttccaaatgatctgtggtctgggtctattgcccacagaaggttgatggcatcctggataagatcaggtcttctaaagcagactcggggttggaatttttgctccatcacttaccagccatgctacttggggtaaattacttaaacaatccgaaccttagcttcctcatctgtaaaacagaaataataataatatttctcatggggctgctgtgaggataaaattagataatgtacccaaagctcttcacacagaaaagcctcccctgctggatctctcatgtaccccctggattttctagcagagtgtggcttctccaaaaccttctcaaacagctgttgagaatcaatgtttgtaatgagaaatattgcgaatgaggagccagaaaaagtctgacagcctttgcagcagggggatgagaaggaggtggttgtgtgtgtcctcagctcagtggtaggtactgggcatgtggtaggaatgagaaagtaaaagtagctattattattaggatagtatctataacttttatttttttgcataaattaacaatttaacaaaaaccag

SEQ ID NO: 259394 - DNA, 449 bp, Homo sapiens
gagtagctgagattatgggcatacaccatcacacgtagctaatttgtgtatttttgatagagacgggttttgccatgttggccaggctggtctcaaactcctgacctcaggtgatctgcccaccttggcctcccaaagtgctgggattacaggcatgagccaccgcacctgaccagtagtaatattaataatagttctagccctcaagatttaccttgtgccttgctgagcactgacacacagtctaatcttatcagtaacttgtgagggagctcctgctattactattattacagattgagtatccctaatctgaaaatctgaaatttataatgctccaaaatccaaagctttttgtgggccgacttgatactcaaaggagatgcttattggagcatttcagatttcagatttttagattagagatgctgaaccagtacaatgcagca

SEQ ID NO: 259395 - DNA, 608 bp, Homo sapiens
atcgaacacgtgaattctgttagatgtggcccttgagatcagagagcgaagctagaaaaaaatggaagttacgactcattcaggaagaacacactgaaagtgaaagattcattaagaatgcgtctttaattctcagatggtgcaggggaagaggagcaggcgcacagatggaagctgaggaaggctgggctgacggggtcgctgtgggtgcagccagggtgtagggtgtgctggaaactcatcagagtcatttgagcaacctcggtcatggttgtggacatcaggcttccaaaactacaatttttcaaaatcagatcagagtctgagaggtgctggtagttagggactgtgccttaggtactgaccctgaaaggtggtgctgccttgaaggaggcctggtgaggtgacttcaaaatgcataccggccagcgggggaaggacccagagcccacctattaaatgagtctaacagtcatttaataaattgggaaattgggattctgaaagctgatgtgtgacttgctgaaagtccaaagctactcagagcagcaaagctaagcagagctgagacttagattcagacctcctgaccccaagaattgagagtt

SEQ ID NO: 259396 - DNA, 294 bp, Homo sapiens
caaaaaataaaattaaaaaaaaaaagtaaggagatttagggaccaactcgtccaactaggtacaggaggcaattgggccacagggggtcatgtgacttgtctgcagctacttgtaaagttacttctggtccagggctttttgcctcaaatactactactttttgggtcaggtactattttaggtactttctatatatgatctaatttttctgccagtcctactgaggaggctggggttgggaggatcatttgagcctgggaggtcaaggctaaagtgagccatgacggtgcaga

SEQ ID NO: 259397 - DNA, 692 bp, Homo sapiens
tacttgtttgctacttcactgaatttccacagttattcaggtttttatattgtagtactggtatgtatatttccatatattgtaaaatatttttctataagttttctcaagtctgtttttgaaccaggatataatcaagtgacaaacaacaacaacaaactttgtattgtagagttcataagaggcagggccagaagaggtcttatagccacattttgcctgggtctcctctggattttcaccatctgtatttggacagtgtgggggatgaaaaattaattgggattaagttactagaaaccactttgtgaatataatttcatttttccaactggtaaatattccttattcaaaataactttttgtggtatgctgtccaatgtaaatgttatttagtaatctgggtagttaccgaaatatttgggttctcttgttgacatagtcatgactgtagtttttgagggcagccattcagtaaaaagtgtttaagaaggttgctggtaaataatagattatgaaagctgtggggaatgcttttctgttttggccttttctatagagagttagctcagctgtccagagcacctgtgtctggttagctcagttaattagagcatgatactgatgacaccaaggtcacaggcttaatcccctagtggactccttgaatttgtttctgtgtcttggctgag

SEQ ID NO: 259398 - DNA, 298 bp, Homo sapiens
atcgaaaagcttggaggtgggaaatttacaaaaggtgattccagggtcagcttttttgtcacctgcttccgacttcggcagtttggagagggcgagtaagtaatacccttcagggtcttgggatgtggcccagcaaaatccttagagggactttgaagtcttagttttaagtttagaattaatgggcagagtacttaaatggccatttctccaaagatgtatacaaatggcccacaggcccataaaaatgttgcattccactctataacatgtttttgcataaaaaagttttaaaata

SEQ ID NO: 259399 - DNA, 730 bp, Homo sapiens
gcatctgtgcccagcctgttctataaagaaagatgtattcatgaacctaaccaagggagtctgagggagatgtagagaagcagagccattggaacatatgtaagcacgtgtgcccgtcttcagggaagggagccatttccccacttcttgagagaaaacagccctcctctagcaccacgaagggcttgatgatggtgccaaaggaagtggcagcagggcctggctgagaggggatgcccagcgggaaactccacagacacagcatatgctgtgcgctgccaacatacagagcactgcgctcgcaggatggtccatgaaaggtctggaagcagcccaggtgtcaatcaaccagtgggtaggtaaataaaatgtgggatatccatacaatatttggcaataaaaagggatgaattactgattcctgctataacatggatgagccttgaatatattatgctaagaagctagtcacaaagagccacatgtatgatttcatttacatggaatgtccagaataggcaagtctgtagacagaaagtagattcatggttgcctagggctcgaggaacagagggatttggcagtgacaactaaaaggtacagggtttcttttggggtaaagagatgttccaattgattgtgctagtggttggttgttcagctctatgaacacagtaaccactggagaatcagtactttagagggtggaattgcatggtacgtgaattat

SEQ ID NO: 259400 - DNA, 201 bp, Homo sapiens
ctgagggtggcttccagatggcctgagagtcagctgcctctgttttcttaggaatcttcagcaaaggggacagatgacctgcttgtgttgtgcaatttgtgtagtgctctggacctccctctctggggtcactgtctgctgccgtggccaaaacaacatgtgctgatttgtaaataaacacagtgaggagccccctgagcc

SEQ ID NO: 259401 - DNA, 677 bp, Homo sapiens
agaaaatttaatgactcacactcttacttcttttaagtactgctgctctaggctactctattcaacctaattctcaaaggcacctcaaactcaacatgtcaacaactcaaagcaaattatttccccttttgttctctacaaatatgcttctcatcaggtattatcatttctaccagcatctcagccagaaacctggaagtctattcctgccttccctccccacacctagtccatcacaaagtcctgttggttctatggttctatgggcttagtatctttgcagctggctactagtcattgtgctatctccagccatctccctattttcatccatgcccctcccaagttcattctctaggacattaactgaatgctctttcatgctactctcctgtttaaatcttttgatggtacaagttgagtatcccttatccaaaatgcttggggccacaagtgtttggattttgggttttttgggatttgcaatatttgcatatacataatgagatgtcctggggacaggtcccaagtctaaacacgaagtttattaatgtttcatatgtaccgtatacacataacctaaaggtaactttacataatattttaaataattttgtacatgaaacaaaccttgtgctaagtactgatatgtggaatttttcactttcagtatcgtg

SEQ ID NO: 259402 - DNA, 396 bp, Homo sapiens
gtctattgctagtttatttccctgatgagattctcttcctgggacagtgggtgtggtgtagggtttgctcttggtaagctatacaaaattgttaatcatcaggaggagatactgtctgtggagaaaattaggtagagattaaaacaaccaccaccaccaccatcaccaccaccaccaccatcaccaccaccaccaccatcaccatcaccaccaccatcaccaccaccaccaccaacaacaacaacaacaactttgaacctgagctcagtggcgcacacctgtagccccagctactcaggaggctgaggtgggaggattgcttgagtccaggagtttgaaattgcagtgagctgtgattgtgctactgtactccagcctcgatggcagagtgagacc

SEQ ID NO: 259403 - DNA, 451 bp, Homo sapiens
agactccatcttaaaaaaaaaaaaaaaagattatccagctgggtgtggtggctcatgcctgtaatcccagcactttaggagggcggatcacctgaggtcaggagttcgagaccagcctggccaacatggtgaaaccccgtctctactaaaaatacaaaaattagccgggtgttgtggcaggcgcctgtcatcccagctactcaggaggctgaggcaggagaattgcttgaacctgggaggcagaggttgcagtgagccgagatcgtgccactcactccaacctggatgacaagtaaaactctctctccaaaaaaaaaaaaaaaaaattaacccaaaaatttgtatgctcaagtttttttttaattaggttaatataattgtaacagccatattcaaataaagtatttctgtgggcttttaaatagttacaaaataaagcttatctcagtga

SEQ ID NO: 259404 - DNA, 482 bp, Homo sapiens
tacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagttt

SEQ ID NO: 259405 - DNA, 436 bp, Homo sapiens
atccagaagtaaacacatttcaggacacttaacatttaaattctatcaagaaatttattttctttgatgtggatgcagccaatttaaatttcatcacaggtgcagaagaaccagaagcaatagaaagaggagcaaatcgatcatcatctagtgcctgtgagctggatttgggtcacctgggtgcctccctgcttcgagaaccaacagtgtggtggtttcaaggacctcggcttctggtttgggaccacaaatatttcctaatctctagaaatgctctcagtttacgatctgctttagacacgcactactaagtttatatcaaaggacactctggtttgaaatgtgctctggtatccatcaatgaacatttttcttcatgctcggtagcaatgatggtttaaaactgttcttgccattaataaatctggaatagggg

SEQ ID NO: 259406 - DNA, 353 bp, Homo sapiens
acagggaatatgcagagttgatatggagataagaacccagtgatgaaggagaacccaagaatctgggggttcttctggtgactggtataaacacagataaggcaaaatgagattgtccagatagattcaaggcaggtagtgttagtaaggctgtgagtgtggggcagaaatgggtgggattgtaggctccttcttcacccctgatggtgggagaagaaggttcatgctcatctttcagttcactaattgtctcttcagctgtgtctaacctgctgtttaactcattcattgatttttcttttcttttgtagatcttataaatctccccaattgtttaaaatgatttcagtatc

SEQ ID NO: 259407 - DNA, 487 bp, Homo sapiens
ccaatttcaaggccagagagctgtaaatggtgaagacagggtttgaacacagaatctgaaacttttatatataggcctatgtttctcactctttgtaagctgggcccgtatcttgactaccttgtattcccagcccacgggcccatgcctggtacatggcagcagctcaatacattatttaattaaggagcaggaagaaaggagtctatggctccagctccatcctgacatagcctcttatgatgtcatcacacagtgggcatgtctcactgtccccaacaccaccaggcttaatgaacacagtatcttctgttcttgaacatagtatcttgatgaacagagaggttcacccaaaagtactcaaacatcaccttttttgcctgtcaggtcccagctgctgacacctgctctctggccctctcttacctgaccatccagagtcctatgtgtgtactttaaagcctcattggtcccttaggtaataaaa

SEQ ID NO: 259408 - DNA, 266 bp, Homo sapiens
gaaaagaatcataattttaagctagtaaaagttgggccagtcttgtttcagtttaaagaaaaataatttacaggaacttttagaacaaaagcagttaaagaatgacctgaggagaacatttaacatttaaagggatagtatgatttagtagtcaaggctgggcgcattggctcatgcctgttactccagcatttgggaggctgagaccagaggattgcttgagccctgggctttgtagcaagagctcatctctacagaaaataaaa

SEQ ID NO: 259409 - DNA, 466 bp, Homo sapiens
tcagtggcagttgaggttgctctttttatgtgggagagtgaaattagccaagattagatcccataaggagaaggaggggctcttataaccaagaccattgtctttctctagaagaggatggttagggacctgaaaagaaatgagattttgtgtttccttaggtaagataggattctttctcctcagaggtgattttagggaagtaattgaagatattttaaaggaaagctccatatctccaaaatattatttagtagctgaagttctaccaggtagtttcagttagctttcagatatgggatgctttgggttgggtgtgggggtgagagttgcaggggcaagttgcaggggcaagatgctgggcaaattgcaggggtgagagttgcaggccttaagtactctattaggggaatagagtacctaaagaattgtgtattttaagttaaaggttatacaagtatatggt

SEQ ID NO: 259410 - DNA, 289 bp, Homo sapiens
ccatcctccaggtttgcaaatcagatcaagttctgacaactggtaaagaggaagatgagaagatcctgccagataaattctctggtaccttcattgatctcattctttcaccatcaaaggggaatgcagtagtgccagcaggagcagaaaaaaaaaaaaaaaaccctaaaaagaacaagagagactagtcaaagctagtacagtgtttccctggtactgagtcatacttttacaatgacccaggcccacggcctcaactgatgacaaataatgagaatccaacaatcat

SEQ ID NO: 259411 - DNA, 346 bp, Homo sapiens
tctgcgggctggagtttggtgcataattaaaactcagcgtctgacagctgggcacagtggcttgcgcttgtacgcccagcactttggaaggctgcagtgggaggattgcttgagaccaagaattcaagaccagcctgggcaacatagtgagctccatctctgaaaactatgtttaaattagctgggcatgatggcatggccctgtagtcccagctaatggggaggctgaggtgggaggattgcttgagcctgggaatttgaggctgcagtgagccatgatcatgccagtgcactccagcctgggcaacaaagcgagaccctatctctaaaagaaataaaaagaaag

SEQ ID NO: 259412 - DNA, 694 bp, Homo sapiens
ggggatttctccccaccaccgagcaaactgcccagacatggacaccggcatgaactgggggtcctccagttaagttctgacactctctacctggagacagcgtcagatcccaggggttgggggcttagtcccccaagaccacccctgaccttcagacatcactcactagtacaggcctcgggaacttctgacaaccagctataaattgataaagaccccctctttattaatttgctagggtggctcgcagaactcggggaaacccttaggtttaccataaaggatgttacaaaggatacagatgaagagatggataggcgaggtataggggaaggggtgcagagcttccatgctctccctgagtgtgactctctccgggaacctccatgggttcagctacctagaaattcttagaactgtgtccttttgggttttcatggaagctttgtgacataggcaggattggccattgatggtcaacttaaccttcagcttttctcccctccctggagttcagggtggggctgaaaatctcaaccctctaatcctgccttggtctttccaatgaccagcctcaccctgaagctacctaggggctgccagccatcagccaactcatcagcattcaaaagtacatcactttggagattctaaggattttaggaggtgtatgtcaggaaatggattcaaaggc

SEQ ID NO: 259413 - DNA, 474 bp, Homo sapiens
aggcggggacgggggaagcagcacgggatcccagcctcaggcctgcccggacggtgttggttggggatcaagatgagtacactgcagccgagaacaagagccccagaggaactctttgtcccacaggagagcagcggatccacgcaagagaacatgcttgtatcttttcacggctcttctctgagaaatgaagccacaccacgatacagtcagcaagaggaagccgggaatgggagatggcaacagtccctgtcactggaacgctggcctctctggacaagccaccctttaggaaccccaccccttatgcctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacactttctgg

SEQ ID NO: 259414 - DNA, 293 bp, Homo sapiens
ctgacctcaggtgatccacctgccttggcctcccagagtgctgggattacaaacgtgtgccaccatgcctggctttaatgggtatattttataatgttacatggaaaaatctgtcagaatttagttaaatctaatactcataattaaatcttattttacgcaaaaattgtagcatactaagttcatctatgatatgaaatactttctaatctttgaaagttaattctatttcctgaaaatgtaacatctttcttcaggaaagggtaagaggtggggtcaaagttgattatccc

SEQ ID NO: 259415 - DNA, 1162 bp, Homo sapiens
cacattgaagtacacgtttcaagggaatgagaaactggatgataggcaaggggagaaagtagaaatcagagagcgaaagttcgcggttctggttcttgtcccagggttagcccaggagcaagtgtggccatccatgttgctggattagagaaagcctaagcactgtgaagccaggttctgcatggactatctattaagtgatgaagtttcccagaatgcaatggcatcctgtgggaaatgtaatcatgggacaggcgtcattttgcttgcagtatacaggcaatgtcctaaaacatgacggtgaaaatggatgactttcgacttcgacttcaaaccattacagctacagagtggaaacaatttgagggtagaggttaggtctgctcttctccataatccctctcagaggatgcagtggtttatacagtgttaatggttcataaccagggtatttgttgaattaatgaataaataaacaaagaaataaatgatgagtgagttgacgaaacaggaacattgattggaagcagtagcgtgaattaaggagtttgttgacccttcctctttgttctgtgagtcataacaaatgaaagcaggaatggccctgtggaaaaggtctgtaagggatgggttattatcaggggatgacacagtttcatttagtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctaactaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatattaaatggaaattttaaataagcatcttgaacagagaatttgaaaaacttttatgtgttctctttgccccactagacccagctctggattacccagttaaaaaaaaaaatgtaagaataaaacaagtgtctaggattcagaggaatggggacatttaaaa

SEQ ID NO: 259416 - DNA, 190 bp, Homo sapiens
gatttttgtttggcattgtaatgaatgcataaatcagtttgggaagaactgacgtatttaagatattgagtcttccaatttatgaacatgttgtatctcttatttatcttctttgatttctttaaataatactttgtactcttccaggtagaggtgctgtacttcctttattaaaattattcttagatac

SEQ ID NO: 259417 - DNA, 685 bp, Homo sapiens
  misc_feature (19)..(20): n is a, c, g, or t
ctttttccctccctccctnntttttttccctccttcggccttctctctctctcggttatttctttcttgtcatttaatctggcagataaagtttggcagccagcctatcaaaggtcagagaggacctctgttttgttccaggaaaaggcaccgttacagttacagatgctctgtgatggagaatccataggaggaaccttgcgctgagctgagcaagaggcacagaaaccggcagaatccagcatccgggttgtcaggcttcctgctctcccttcctacccttctctcagaagagccctgctggctggtcaatactgtgaagcccactttagaatctctgattacactcttatgctcttcccttctctgtaaggagaagaggaattagaaactcgtgagatcaatcggttctcttcataggcctcgaaatggcctggacttttatcagaggctaggtcagggctgcaggaaggggctaagacaggaaatgctcgttggacagagctggaagaggtttgtatttgacttgtactcacctcctcagagactgcagatgtggcgtctccttttcctcctgaggacccctgcaaagcatttgtgcctaagacagaatgtttgaggagatggacactctgtctgtcaacatcttgtgctaccagctggatacattgtgtgctcaattgga

SEQ ID NO: 259418 - DNA, 543 bp, Homo sapiens
ttggaataatttgtaacttcttaggattcagaactaaactgaagtatatgtaagcttcagatcatgtcccagttatatggtgggaaatgcaattccagcacagcttcactgcctacacaaggaaggaaaaggtgtttctgcagataggacgctatccttccttgctccagccctgaatattagtgcatgcttcagggcaggtttaacagcaccaagagtgggtatactctttatattagcctggtagattgtgcttctaatctgctcacctggccagcacatgtcatgttattttccctaatcacgtttatagaaccatagtaaccagtactttcagtgaccatgacttagggtttttaattaatgactggatttaaaaacatccttgagttggttttggctgttgtgaatctttctcagatacagagtgtcctgagccagaaatctgagatataccaaggtgaaatccctgtttaccctatgcctttacttctcagagagagggttgaaaggaatactttatatttgtagaactgaaaaaaa

SEQ ID NO: 259419 - DNA, 620 bp, Homo sapiens
aaaaaatatacaaaaattagccaggcgtggtggtgcgcacctgtagtcccagctgctcgggagtctgaggcaggagaattgcttgaatcagggagtaggaggttgcagtgagtagagatcacaccactgcactccatcctgggcaacagagcaagactccatctcagaaaaaattatgtctagcttaatttgtcgcagataccatgctctggggattctaaaataatttctaatctgtactgaagcaatgcccagagtcaaccttgaaggctgtattgtaagcctcctccaggagggcactgactccctggcagggagagaagagggtgggaaatgatagagggctacggtgaagtgggattttacacacatttataaccttcacgacaatccaataaactagggaccaccatacctattttacagatgaggaaactgaggcccagagagattaagatgcttgcccaagtctcagagctaataaactgcagagttggaatttaaatcttggagaaacaactgataaggattagagagtctggtttccagtgtgagctctgaaaacgcttgcttgtatagctgctgggatatctgttttgttatgtttttttatcgcatta

SEQ ID NO: 259420 - DNA, 536 bp, Homo sapiens
ttgcacactctcttacccccattagtgggcttagtgttcatacccagggtgaacctggcagccatgctttaaaggcagagggtgggccacaggtgactgtggagaacaaaggactgtgaagtgggtggaaaataagcatcgttgtgctaaggcactgagacactgggctatgatagcagcagccagccctgcccaccctcactactacaagcattgccttccacattagtccccaaattgtgtgactactgctctaaatttttaatattagaaataaagtctcataaataataaaaagacaaacgacgttacaattctaatgggggaggggtgtacaaatgctttagttgtcttagaattcgtttgtatccagtactgctcaaagtaagtaaattccatgggaaagctttgatatctccagttgaatcacagatttgagctatagcaacatttgttgatatagactctgactagtgttctatttagcttctaactttaagaaattcccactggcagctgaacagtcccaattcttt

SEQ ID NO: 259421 - DNA, 404 bp, Homo sapiens
agttcctgggggaacagaactggtcccagatctggcgcttcttctgctgggaagcacgtgcaggagccggtgctccagaggcgagcagattctggctcaggggaaggggcttgtccagggccatccggccacacacagtgcagcagatgggccgaggtccccgccaccacccgggcgacaggaggggtgacctgcaccggaagtcaggagcaggccttctagctccagggccatcctgagaggaaagaagcacttcacctttccccattcattggaggcacgtccaggcttccaactaacctctctacgggaatgaatgtgaattcctctcaaactctgggcataagaaatgacacgtttttgttacatagacatattgcaaaaataaaaaataaaaagatgta

SEQ ID NO: 259422 - DNA, 539 bp, Homo sapiens
  misc_feature (12)..(12): n is a, c, g, or t
  misc_feature (14)..(14): n is a, c, g, or t
caactcgggggnanagaaaccagggttagaaaaattatacactctgattttcagaagggctgaaacttggagaactgatcccagggaaacaactgcctgcttcagctggtttaagaattttagtatgccccagaacaggttttcctcatactggcatttgtatttgtgggaagagagagagaccagactggctgcctgcttgtctgcttagcagcaaatacaacctgaagttaagcttgttgacagcatggcccactcacatccagagaagttgtggttagccctccacaagtgggggaaccttcttaggaaaacaagcgtgcatacaagaagctcatgtaaactctatatattgaaaacttgaatccaacattcgtgaacatgaaagaacaggacatttttggaaaactatgatgaaagaaaaggaacaagatgaataaacaaaagttatgacccaagaggatgtaagataaaaaagaacaataaaataaagttgtaattatcaccctttgagaggtctgaaggttcctgagaagaga

SEQ ID NO: 259423 - DNA, 3421 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259424 - DNA, 3373 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259425 - DNA, 3717 bp, Homo sapiens
tttttttaaagagactaggtttcaccatgttgcccaggctggtcttgaactcctgagctcaggtgatgcatccacctcagcatctcaaagcactgggattataggcatgatcagtactttctaataagcagaaccattgtagtcagactgccccgccccctcccccgccagcagcgtctggctcagaggagggtctggggctctttgggggctgcagccatctggaagctccactggagccgattggtctcagttgccccactcgtgctgccctagtctcctcgtgcctcacgtgctgtcggtggtgcccttgcgccctcctcacagggactttccggtggaggacgttttcaccctgcctgtgtacttctcgtccgactggctgaatgagttctgggatgcactggatgtggatgactaccgctttgtctacgcggggcctgcgggcagctggtgaggccacggatgtgggagtggaacccgaaggggcctggtgacagaacggactgggaggcccagggtggcaggaggggggctgcttggcacaggcctcacagtgggtgccatcccttgagaccaaggggccacccctccttcagttggaccaggcctctggggtgccaagcaaagcccataccagcccctacaggcatgaaccaggcgctcttgctgccgcaggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggtaatgtgctgcttctcctgccccctatcaggggccttcctgcaggaagacggcagcaccacctccccactctcccagccagagctgggctggaatggggtggctcatgggtgaggctgaccccttcacaaggtggtgtcgctgaggcctagcctctgtttcacccactgccggtccctgggtctacttgctctgggttcactgtggcctgaggtggtccgagcccgccacccacttccctgctgagcaagccctgctgggagacaggagggccctcttggctgcagagggctggaccccacagtgggttcctggcgcaggagatgtgggttggtcagggggcacctgccatgggctcaggcctgcctgcactgtgccccttccaggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259426 - DNA, 1544 bp, Homo sapiens
  misc_feature (49)..(49): n is a, c, g, or t
  misc_feature (92)..(92): n is a, c, g, or t
aagggccaagggggcttgggggttttggggcctttcccattcaaccttncccagggttgaatgggggcttgttgggaacccaagccgggccntggcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259427 - DNA, 550 bp, Homo sapiens
gcggccgcagaccccgggcggggaggaaaggccggcgggacccaggcccgggaggcccccgcctagagaggggcaccagggagggtgagggaggccaggcgcgtggcccctggagagttcctctgcagacggtttggagtgaggacggggcccagggagatggcatggaccgtgcctttcatttcaggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcaggtaatggggcttgggacgcaccgaggcgctgccttccctagcgctgcgtgaacccagaggcctttctgatgaaggtggcccctgggtgcacaacggagctatttttccccgtgaggcactttaatcagtttaaaagaaactggattgtcttccgcatggctgcaagtgttgttctttgggaggtcaatatggttttt

SEQ ID NO: 259428 - DNA, 1338 bp, Homo sapiens
gcggccgcagaccccgggcggggaggaaaggccggcgggacccaggcccgggaggcccccgcctagagaggggcaccagggagggtgagggaggccaggcgcgtggcccctggagagttcctctgcagacggtttggagtgaggacggggcccagggagatggcatggaccgtgcctttcatttcaggagacgtggttgtaccagttgcaaactgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259429 - DNA, 530 bp, Homo sapiens
gcggccgcagaccccgggcggggaggaaaggccggcgggacccaggcccgggaggcccccgcctagagaggggcaccagggagggtgagggaggccaggcgcgtggcccctggagagttcctctgcagacggtttggagtgaggacggggcccagggagatggcatggaccgtgcctttcatttcaggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcaggtaatggggcttgggacgcaccgctgcgtgaacccagaggcctttctgatgaaggtggcccctgggtgcacaacggagctatttttccccgtgaggcactttaatcagtttaaaagaaactggattgtcttccgcatggctgcaagtgttgttctttgggaggtcaatatggttttt

SEQ ID NO: 259430 - DNA, 3223 bp, Homo sapiens
ctggtactggtcccgaattcgtttgatgacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259431 - DNA, 3349 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctgcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259432 - DNA, 1557 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtga

SEQ ID NO: 259433 - DNA, 3194 bp, Homo sapiens
aggctgggtggatcggccgaaggttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259434 - DNA, 3132 bp, Homo sapiens
gcggccgcagaccccgggcggggaggaaaggccggcgggacccaggcccgggaggcccccgcctagagaggggcaccagggagggtgagggaggccaggcgcgtggcccctggagagttcctctgcagacggtttggagtgaggacggggcccagggagatggcatggaccgtgcctttcatttcaggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259435 - DNA, 3026 bp, Homo sapiens
tcaggctaggtagaggcccgtgttaatcggccgaggcgccgcggggagtgcctgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcccatctgctgctgaatcctcacctgggcctgagggactgtgcctgctgtgcactcacagctgggtcttcccaaggatgctgttctcaggagtggtgggtccccagcccctcttcacactgggtatgatggaggtgtgggcgggctcgtccaggccgatcaaggcacagcagtgagcagcggaggcctgtggtggggaatggactctcgtgggatcctcttgcagaggatgccccaggcctgaaccctctagtggatccacagtttgtggagactggcactctcccagccctgtccttgaccgagagtccagcattttttcagttggcccctggttggctgcctcaccccagcaggggaggaggcatccgaatccacagggacggcacgtgccatggctatgcacattgcctgcccgtggcatcaactggggccgctggcacttgtctaggatggaagcccccaagaagggcaggggtttctgtctgctctgttcagtgaatcatgtgaagtgcttgcaaaggcagctttacacagtaggtgcttcatatgtgtctgtcgaatgaatgcgctccagccaacagctttccagggacctgtatgctgggcccccctgctagctcccggggacccctggtctgtacgggaatgccctgagacatccggcctcctacagatggagctggcgctgcccaaaccacgggcagcaaaggtgctttgtcggggaggagggggaggtagcaaacatgcacggctgcagccttgccaggaccaggcccaggctgagtgtgggcgtggctcacccatttagcccctccggtaacctctgagcttgggcctcttggcaccctgccacacaggcacacctgaggccaagagtgggggtatgtgcctcggacactgccagcaggcagctgaggtgacctgtccttcagcttctgtcatgatgagggcagcactgtggaccccagggcagccagggcccagtgcgaactggcagcacaaggtagcacaggtcgcagcccattaccatccaggctgcttggtcctgcgctcctgaactgtatgtgaagaccctcatgcttccgcagtcaggaggcagtgcacagacgctcccgagagccctgctagcctcagtcactttttcttggttaaagcaggcattgagaatctcaggctggggctgttacagatgcagcaaaaacagcaaatgccagaagctctgtggggggagatagagccctccacagggcaacggctgaactgcagccggcatcgatgactccatagtcaatgaccatgactccttttgcatacctcactccagattggc

SEQ ID NO: 259436 - DNA, 1509 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggatgacaccatctccatcaaccacaactgggtcaatggcttcaacctggccaacatgtggcgcttcttgcagcaggagctatgcgccgtgcaggaggaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtga

SEQ ID NO: 259437 - DNA, 1943 bp, Homo sapiens
agacgagtcccagagccgaccgcggcgcctcggccgctcggcgcctgcgcagtgaagaccgcggcgagccgcgcgcatgcgtgcaggcccggagccccaggcgctggtggggcagaaacgcggcgccctgcgtcttctggttccgaggctggtcctcaccgtttccgctccggcggaagtgaggaggagggtccttcgacccgtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcagggactttccggtggaggacgttttcaccctgcctgtgtacttctcgtccgactggctgaatgagttctgggatgcactggatgtggatgactaccgctttgtctacgcggggcctgcgggcagctggtccccgttccatgctgacatcttccgctccttcagctggtctgtcaatgtctgtgggaggaagaagtggctcctcttccccccagggcaggaagaggccctgcgggaccgccacggcaacctgccctacgacgtgacctccccagcactctgcgacacacacctgcacccacggaaccagcttgctggcccacccttggagatcacgcaggaagcgggcgagatggtgtttgtgcccagtggctggcaccaccaggtgcacaacctggtaatgtgctgcttctcctgccccctatcaggggccttcctgcaggaagacggcagcaccacctccccactctcccagccagagctgggctggaatggggtggctcatgggtgaggctgaccccttcacaaggtggtgtcgctgaggcctagcctctgtttcacccactgccggtccctgggtctacttgctctgggttcactgtggcctgaggtggtccgagcccgccacccacttccctgctgagcaagccctgctgggagacaggagggccctcttggctgcagagggctggaccccacagtgggttcctggcgcaggagatgtgggttggtcagggggcacctgccatgggctcaggcctgcctgcactgtgccccttccaggatgacaccatctccatcaaccacaactgggtcaatggcttcaacctggccaacatgtggcgcttcttgcagcaggagctatgcgccgtgcaggaggaggtcagcgagtggagggactccatgcccgactggcaccaccactgccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtga

SEQ ID NO: 259438 - DNA, 228 bp, Homo sapiens
acccaaaataaggaaaacaaggatagatttttatagagaaaaatatcgctatcccctgttatcttctttgagctgtggaatcacctccacacatgttcacaggaatcccaacagagctggcatgctttctcagctttcttccctgtcctcccttttgtggacccagtgtgactaaatgagatggtgcatttcagactcagattcaataaaaggttcctgagcatctcc

SEQ ID NO: 259439 - DNA, 416 bp, Homo sapiens
tttccctggagaaaactgtcactcatcaagaggatgtccatggcaatctaagtggagattttcccaaagggactacaaatgtcagaacccaggtgatctgacatcaatgaatcttcctgaaagccccttgggatgtcatctgatgacatgagttagcattggtggactagggttggaagatctgacttgagagccaatttctctgtgtacactagtcagctgacctaaggtgtgtcattgccttctctgagtctcaagctcctcatctgtaaaatagaaagaatatggccttaccctgacagcatattgtaaaaattgatgagatatgatttaactataaatgtgctatgaatttaaccatgcagtttaatttatgtaactgtgaattgtagactcttatttaaacatgtggtatt

SEQ ID NO: 259440 - DNA, 317 bp, Homo sapiens
tattgctgcctcatataatgtataagttatttattatccatttcttcctttttaagataacttgtgggtatgtctgctcctagtaccccagtgccgagaatctggcctggcatgccatttcagaaatccctgctgaatgaacttcatgggagtggcacacctgagatgctataactgctccagaacccaccaggcttcactaacatcagcaagtgcttattcagtgtgtttgcatgctgaacatacaatgacagactgttcatgttccccagaaacaaaattaagtaatccaatgcaggcaagaaaactaaattgga

SEQ ID NO: 259441 - DNA, 519 bp, Homo sapiens
cctctgcatagatctttctaagtgatttattagggatacttttttgattgaggattttaatggagggtgatgaaggtaagggacagagtctctaagccaagaaagtcagactctgccttcaaatctggctccaactgcaatctatgtgagagcaggccatttaccctctttgagcctctgtttccttggtagtgaacaaggatgacaatgtattaacttcataaggttgttatgatcatcagtatcaaataatacatattgaacaagtagattgaccctggcacactgtaaaaactcaacaaatgtatttgcagttattgttacatataaaaataacttactacaaaatcgaccccatcttctgaatgccaagcctttccccccacttattatataatttgtcaaattcaaattattaaactgaaagagctttacatttttgataaagttatttacctttcaaatttcctggactcacttctcactggctagggaaaacgtttttctggttctcaagtg

SEQ ID NO: 259442 - DNA, 635 bp, Homo sapiens
ggggatgtgggaggcagacattaagggaagatgagggatggagctgcacaggaaaaagattgttttacaatgcacataaagccccccaggtaatctcttggtgctactctctgaagaatagataaaaagtctgtatgggtgaagtgatgactatcagttgcttctctcctctggtggttgatcttttctggtaacttgatgagatcctgagggagggtgtttaagacaattgcatttcttttggaagaaaacattttggtcaggtaaggaaatttcagagagagtcctttcttaaacttggttggggtcggaaagaccaggttagagagaccttgattctgaggcaacttctaaggcatctcagcatgtgccaatctttggggtatcactttctgagcctcagtagtacactagggtaagtgataatgtttcaatagcttgagtgtattaaatgcaatttcaacttatgatattttcaattgatgatgtgttcattgggatgtaaccccatcataagacaagaaacatctgtattagagaagttctgattccttgcatccttaatgcatttggctatgagaaataaaaatacagtactaagccctccaattgactgacggaccccctcttggcca

SEQ ID NO: 259443 - DNA, 581 bp, Homo sapiens
cttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagc

SEQ ID NO: 259444 - DNA, 161 bp, Homo sapiens
tataaaatatgctaccttgatctttatccttcttccaaactgctcaatcaaaattaattcatctcttccccttccttcctacagcaacatgttagagtcgttcttggagagcttatccacttcttctgccagttacattctcttgcgtgcatacaccaacc

SEQ ID NO: 259445 - DNA, 495 bp, Homo sapiens
aggttccagtgattctcctgcctcagcctcccaagtagctttggattagaggcatgtgccaccacgcccggctaattttatttttttttggtagagacggggtttctccatgttggtcaggctggtttcgagctcccgacctcaagtgatccgctcacctcggcctcccaaagtgctgggattacaggaaaaattttactttcatgaaaaaattcccaaactttatgcttcctctttttaatttaaattgttggtgagcaatggtatttaaaggacaagacaccttgaatgaatattactagtgttttagcaactcaaacattggctaaagggtatttgaaagttgtatgtctgcattaatgcaacttcagatttgtgtgtgtgtggatttgttcactgcttagtgatggtaaagtcaagagttttctttaattactctccatgaaaagatttttttctcttttgtgtgcttctggattcaattgcctgttttta

SEQ ID NO: 259446 - DNA, 281 bp, Homo sapiens
ttacgaggccagtatgtggctgggagggtttccaatcccctgaactgctgtcattggctgcattcacagattcatctctccctattacttatgagtctgccacacacaaaaactagtaacaagtacaaccctgaaaacacaggtagcaaaacaagtgaaagtgaaaaatccagtcttgagggcttcatttcaacacaaacctattcatgtgacaccagcttaggttggcatctgcacaagttaacctcatgcttgtgcaccagggcacagggaaaggaaag

SEQ ID NO: 259447 - DNA, 811 bp, Homo sapiens
ccagaaatggctccccagagaagctgggacagattcaaccctgccagcggatgccattgctaggaccgtgatgacacacatagaaacatgcacacagcgatccacctcacccagcccttcacatgagcaaggcgtgctgtgtaaaagaccccctgaattctcacaccaaccctgggacaaagctaccatcgttattcccgttttacaagcggggagacacaagcacagggcttcagtaactggcccgcggcactgaggccagcgagggcagagtcaggcgcaggcccggaggtcagttccactccggctgtgcttttcttctggtgccctgttttggcatttgtgtcatagttatactgatgcctaattcccaggctgcaatgaggcttagataagacaactgaatatcttaataaaaatcacaaactggctgacgctgcagatctgtaggagaagaggaagctcgttgctttgggggaatagcacatgctcccatttccccagcccactctttaagcaaagggaggtcatcctgtgatcacacaccttgtagcccagtatgagcccattctggtcctgttccggcacggatgtccatgtcagtaaaatctgggtcgagctgacagcctcggctgacacgttctcaggggcggctgaaggaactgcaaagaaccaatgaagtagattagcatccaaaatctagagtgtctacatacaaagatccagctttcacccaaataatcaagttgtccttgaaatagcaacgtattctaagcattttgtagtgatcagattaaacctacaggagtat

SEQ ID NO: 259448 - DNA, 1890 bp, Homo sapiens
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcacttttttttttttttttggagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 259449 - DNA, 1902 bp, Homo sapiens
aggcggagtccggctggagaatccccctgggtcgcgcagtgcggggatccccgcttcagtcggcagagagagagctcgcgggtggttccggtccggcttttcaggccggacgggtgcctgcccctcaggtgcgagtttgtgcggtaaagaacacaccccggagatgtggacacggccgccccaggagggtccttgtttggaggtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcacttttttttttttttttggagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggca

SEQ ID NO: 259450 - DNA, 499 bp, Homo sapiens
gcaatattgttatggcctcttgaaaaatataatctgccataggacttatgttaagtaagtccactatcagcagctgaggaaatccttgtagggtattggtagccaagggccttctgccttcagtatcatcccaccccagcagctgaaggatgtcttttatttttctttatctaggcttcagagcgcctaccatatgtattttcctattctgtgttatgcataatttttttgtccctatgtttaacaatattgagagtaagcaaaaataacttagttacttgctccagaacatccttttccctaaagataagacagtgaacaaattaaaatagcttggtcatcacagcgcacttcaagacccttggtccactggtccctccaatccaaaattataatatcaaaacctctacccaatcccaagcagttccctatcttgcaaagcctgcctcaaaaatcacctacctcagtccttaaaaccccataatatcctcctggaatt

SEQ ID NO: 259451 - DNA, 319 bp, Homo sapiens
cccaagggaatggctgaattggcgtcgtgcgtcttctagatatgttttctctggcagaccggggagcttccagaaagcacatcaacagatggaaaggcaaacccctcagccatgagatgttgccgaagtttactccaaacaaggaagtcgggaaaatcgccacgcccacttccttctagccactgcccccagcactggcctggagccccgatagtgtttcttctccactgtccctgccaggaaggtaattgtcaaagtcaccggaggctctatgatgtgaaatgtacaatcgaattagaactcgccccttaccaaccat

SEQ ID NO: 259452 - DNA, 667 bp, Homo sapiens
attttcccaaaataaataatcctgtgtcatcatgaggaagagctttgggatggggtggggtgagggccgagggaaaagtttgctggggacccatcacggggcatcacctcctccttttccttttcctctctcctgtccccacccactggccacacaagctagagctgggccatttgctagacagagggggtggtgtttacagtttcgtgaaaggcaatcgctaaccctcttgaccaaccatcacaccctgttgaatgtaacaggtaacatcctgcacacacattcagatctgagtacttgacagcaactgtttttaatttgcagatgatagttggtttcatgaaaacaaagatcttcctgcaaatcttgtaggttaaaactaaataattaactgcatgaaagtgaagtactcaaaatacaattggacatcagatatgctgatgaaaagaaactgagaagtgcacccagcagagccagctgccctgccctctccacaggggcctggggatgggaatcctaccctcagtgggatatggtgctggagctgtgggttggagcgatgttcatgggatacatgtgcagaacatgcaggtttgttaaataggtatacgtgtgccatggtggtttgctgcacccatcaacctgtcatctacatttggtatttctc

SEQ ID NO: 259453 - DNA, 415 bp, Homo sapiens
gtctcacctctcatgaactatgaaccaatattttaaataaaccccctaataaccccccagtcactttgggaatataataattacactgaactgaatgtgtgtgtgcatgtggatgttggaattgcttacttgttaaatactgatgtttaaaatacacgacaaatcttgtaaccctattttggcatatctttttcttcttctttttggtttttgtttaatatggaagtggacagtgcctctcttgacctctggaaggccctatgaaaacctgaaaccgaggcaaggtgacaaagtctggtcattcagcactaagggccgcctcagattacttctttacttagaaaaacaaaatgttgttgcaaaagattcagagtcacaaatattcttcccgggcctgtcagtttctgaattctta

SEQ ID NO: 259454 - DNA, 613 bp, Homo sapiens
caggaagagctcattagagcttcttacctcccaggccctctgccactcataccacatgccagcccaccctccatttcacagggccaccccactcccatctcacagaggcagatgccagggccaagaaagggtgggggaccatttgtagccacacagctggtgtggcatggccagtgtggccagcaagcagggagtgagaagctgctccactgatgggtgcccaagaccccgaggcaggcgcaggtgaccatagcctgagagctcctggcaacactggtctgcagaccagcagtccagcctccactcatatccacattggccagaaacaagagtggtgctgctacacatgacagagtaaaaactgaggacaagcctggttgaggttctggctgggactgcatgaagttaagagaccataagcctgaagtggctggtgtgtgtgatgcctcatccagaaaagggcaggggccaggcatctgaggccaagcacagggtgggattgggcctgctgggcccagcccagtgttgcccctcagggccccagagccccaggggagcaggcgggggccatgagggcttggcagccgcagagacaaaccagcactttccctcc

SEQ ID NO: 259455 - DNA, 217 bp, Homo sapiens
gtcaatatttatgcctagcaaccttgacaatatccttttaattaaaatcaatggagaaataaaacatgcattagaatgcacgtgggatcactcacctcacgagacagagaaggaagactctgatattatgcacgatgtgattatgacaagacgctggatcttctgtatgagacatgggttctggtatttgcaattagatctcttcttttgacggttg

SEQ ID NO: 259456 - DNA, 584 bp, Homo sapiens
tctgaacagtagtctcagcagtgggcttcaaatattaaataaaccatgctgtaaagagatgttctgtcttacaagctttcttgttccatttatagagcacagttcaagtaggtttagtgtaactcttaagagccctaaaagttttagaatggtaaatgagtattgtcttcaacttaaagccaccagccatgttagctcctcacaagagtcaacctgtcctttgaagctttaaagccaggcatttttcctccaacataaggtgatttcatctacattgaaaatatgttttcatatttgtttagtatagccatgttcatcaaacatcttaccttgatcttctggaaacttgctgcagcttataatcagcaattgcttttttaccttgtactttcatgttacagtgatggcttctttctttaaacctggtgaaccaactttttctaacttccaacttttcctctgcagcttcctcacctctctcagacttcatataatagaagaaacttagggccttgatctggattaggtgtcagcttaagggaatcttgtggctagtttgaccttctatccagaccattcaaact

SEQ ID NO: 259457 - DNA, 687 bp, Homo sapiens
ttggtgagacttgaggagtggtaggcataaattctgcattctgtttttgtcacaataatatttgttggctactaggaatctaaatggagaagtaaagttggcagacggtcatacaagctgtagcccagaaaacagatataagatgaaattaagaaactatcatagaatattgtattaagaacttattgtaggccaggcactgtcctgattactggaaataaaatggtgaagaaaatacatatgtgataggcagaattcttggctaccaaggtccctgctccctgatgtgtaatatcctcttcttgagtatgggtgggacctgtctatatgatgaatatagctcccataattaggatatgctatggagcagtggtccccaacctttttggcaccagagactggtttcatggaagacaatttttccatggattgggggtgggggatggtttggggatgaaaccgttccacttcaaatcatcataaggagcatgcaacctagatccctcacctgcgcagttcacaatagggttcatgcgctcctatgagactctaaggccactgctgatctgacaggaagcgaagctcaggtggtaggtaattttccctccaccactgctcacctcctgctgcgtggctgattccgggtctatggccagaggttggggaaccctgctatatagcacagtt

SEQ ID NO: 259458 - DNA, 597 bp, Homo sapiens
  misc_feature (454)..(454): n is a, c, g, or t
  misc_feature (468)..(468): n is a, c, g, or t
  misc_feature (503)..(503): n is a, c, g, or t
  misc_feature (512)..(512): n is a, c, g, or t
  misc_feature (534)..(535): n is a, c, g, or t
  misc_feature (544)..(544): n is a, c, g, or t
  misc_feature (567)..(567): n is a, c, g, or t
atccctgcatttctagtagttacttattcacagtgtcttaattcttcttttaatatgcttctgtgttctaataacaaattatctgagatttttgaaaattacaactttattgagatataatttacttactatacaagtcacccactgaaagcatatataattaaatggcttttagtgtattcacagagttgtgcaagcatcacaatcattttagagtattttcatcacccccaaaagaaagctcatacttggccagatgtgctggttcacacctataatcccagcactttggggtgccgaggtgggagggttgcttgagcccaggagttcgaaatcagcctgggagtttgaaatcagcctgggcaacatagtgaaaccccatctattgagggaggagaggagaggggaggtggttttttttttttttttttttttttttttttttttttttttntttttttttttttntttttttttttttttttttgttttttttttttttnttttttttntttttttttttttttttttttnnttttttttnttttttttttttttttgtttttntttttttttttttttttttttttttgtttt

SEQ ID NO: 259459 - DNA, 388 bp, Homo sapiens
tctttgcagatgggattcagttaaggatgttgagatgaggaaatcatcctgcattacccaggtgggcctcacatgcaatcacatgtatccttaaaagaggcagtcagagggagattcaacatgcatgcagaggaggaggtcatataaagatgggccagagagggatttgaagatgttggacctgaagattctgcttatgcagccacaagccaaagaatgctggtagaccccagaagctggaaaggaagaaacgggttctcctccagaacctccagagagagcgcagccctgccaacaccttgatttcaacccaatgatacctgattttggacttctgacctccagaattgtgagagaataaatttctgtggtttcaggcaaccaagtt

SEQ ID NO: 259460 - DNA, 915 bp, Homo sapiens
ggagggcggggtaagaggacggccgttccgggttccgcctgagcccgcaacgcagaatgaggaggcgggagcggcgcggtgagagagaggcggatgaaggggcgccgacttctcttccagggccatgcgcggcccacgacgccggggccccggaggacgaggacgacgaggagcaggcggtggcggcagctccccacgctcacaaggccactgcttccccgcctcccggctccgcccgccgcgccgccactgtcgcacggcatgctgggagcgagaggcggggtcggccccgccgggcctggggagagaggcgggtcctgtcggcggggcggggccgagagaggcggggccgatagcaggccgccccgccccccacggccccaggctcttggacggcgaagaggtctgggcgtagtagtgacgaatcctaagacaagggatctccactactgcggccacacacttttctcccaaacgcttcccggaaagcaccggagggctgggcagtcaggtgtaaacaggcgtccaatcaaggacctgcagtgtgggtggtgggggctggtgccctggggtgcgagcgcacacaggcgtgcccttggtttcacgtgcgccagttttcccactttctacgggggggagtggaaagtgaaaatagtaagatcgagaggtggatatccaccttcccaacctccacctgaaatgtgcccatcgagtcctagcaccttttaccatttcttcccaatgaaaaaaactaaacgatgtaagggaagggagtaccacgaccaccaaaccctgtcctctgcaatgtgaaatgtgctttgaagtcctctcaccctgaggcttgcccgccttctgctggtgaaagaagctgggggctaggcgcggtgggtcacgcctgtaatcccagcactttgg

SEQ ID NO: 259461 - DNA, 696 bp, Homo sapiens
aagagacctgaggaataataaaacactagaaaggaaatcactaaggaattatcagtagactttctgcaagcagtacatttgtataatttattactggatatataacaatatgatctcttttaaaatatacttatttcaatataacatacataaatgtacataaataatactttgtgtagttaatgagtctttacctactcaaaggaagaaagagaaggttatcagcatctagaaagcacactcctgccccctcccaattacagccttctcaaaatctaatccctatcagagggtctatcattaggaattaattctgattgttgaactttatacccaatgtgtacagagtgtgctttcttttgtgttggacttccttcactcatcgttatgtgtgggagatgcacccatgttgtgtgtggttgtagtgtattcattttcattgcaatgtaatattccactgaagaagaagtcgtgatttatgcattatactgttgagggccgtttgggatgcctacaataaataacagtgctataacatccttgttcctgtttctggtggattcatgcaaacatttctattgagtggaattctatttaggagtggaattactggctgacttagatcacattccccagaagcaagagtctgagatgggtcttactgtgcaagtgatttacagaaagggtgctctcagg

SEQ ID NO: 259462 - DNA, 432 bp, Homo sapiens
caatatttcttactgtaaattatcaaatcacttttgggtgcattgtcagtctttctgtacatggattcgtttcactgtggcaaaggcaacttgcagataagctgataaagattccagaactacaaatcaaactaggccctggagtagcagtaaaattccaaacccaaaggcccatccagtctgtccactacattcctatattgatgagagcagaacagacactcatgagagacatgacttctgcttcccccataactaagaagagagattaccatactgatgatctccctggaggtttcatagcaaggtttgacttgatgaattaattaataaagctaaatatcctgaagatttggtggaaatatgctttgacatttacatctaagtgttcatccgtgaaaatcaataaaatattttttcatgcagacccta

SEQ ID NO: 259463 - DNA, 106 bp, Homo sapiens
cattcaagggaccagtccgcactgacacctgcctccagattgcaacaattctctatgaagtgtgcattcagctgtatgctatttagcgctgtgttaattattattg

SEQ ID NO: 259464 - DNA, 221 bp, Homo sapiens
gacccagatcaagtttgactgaaaggcaaacaccattcccaactggctttaccatctgtctttccacagagacaactcacaggctataaagtgcttaacatttccttggcttcagaaggcactagggaaggagagcttaaggtaccattaaaaaaaaaaagaagaagaagaagagaagaagaaagaaaaccacatcttggttaaatgagtggctttgttgc

SEQ ID NO: 259465 - DNA, 701 bp, Homo sapiens
tatgaatgagggttatgcagcttcactttttggaaaccagggtgactagattactgaatttaactattgattagccacataatgatgaaaagggaatcttggcctgggtatcacacagtaatggataatctgcttcctggggctttgctttggtggctatggcagctgagttggcgtggtagatggatagatgggaaaggactgcagaagtcagcataatcctcaattaggataagccttatggttaattgaatgttgagtgtacaggttaaatcccattataacgaactccaggggactggccaaattattttgttgtactgggattagactttattaaatattgtttaaaacagtctttttgttagaggtgttagagattttggaaaaatttccatttattgtaacaatttgacaagttgttcatgaaccttccatctttaatgcttttacctttaaaaagaaaagaaagcatgttgagctgggcagtggcagagcatgtatatcacccctccacaccatgttttgagtagctcttggtttatgtcgacaacctaattagtttgttagtaagtactaccaccatctaagtgtggtcagaagaatgggaaattccccaggtttgcaggtgactggtgctgttaattttttctgtccccaacaacatgtatatatatttttaaatttaaccctgatcctta

SEQ ID NO: 259466 - DNA, 411 bp, Homo sapiens
gttcagaaaagtttgtgaatgttgacagacccttactgttgaaatgcctgtgtttggtgcatatacaaactaagaagtaagaatatttgtttaaattttctactgtgttacctctactcttgcaatactggatccccttaactcacagccgcagaccgtgggaagaccggagtttcaccttataatatcagacattaaatatctacttttatctatacagtacacatagaaggctatgtgactatttagaattcaatgtttgtttactagttcatctttagcttacatgttcattagttctgagtagaaccaagaaaaactaattgaagagtatatgcttatgtattatctcttgctgtgatttaaccaatcttgttacatgtattactaataaaagtcccagcttgaatg

SEQ ID NO: 259467 - DNA, 687 bp, Homo sapiens
ttccttcctttctttctttccttctttcttaaataaaactcttcatttgtctctaataaaaatctgaattttaagcagactcttggaccgctgactcaaatccatcaagtcattcaactttagcccctgtctcattctcagtagcatttcaaaattactgcttttctataaagcttcaagagttttcccaattcttgaacttcggcttcctcaacatgttttctattttataggagacatcatggagagaataaatggattgcaaacttttctaggtattttccactgctttctgcaattaatttattaaccacttttttcaaggcacttgcctgctcctcttggatcatgatttccatcttcttcttccggatttgatgaatctgtgtgtgctgagcataagaggactttcaaatttgattgttgcaattcttagtaaaaccagcactgaagagatgaagcaaataatcattggtagtcttaacatcaacatcagcttcaaaatggtctgtcattttttaaaaattgataatggaggtcacttctcatgggtaagatctgtgtcatagaagatgatcaggcggtttttttcggaacatcctcattaagtaatttgaattttataaaagcaacttaatcatccttggatcagcaaatctcacttgcaaaacacatcacttgaggcca

SEQ ID NO: 259468 - DNA, 515 bp, Homo sapiens
gcgaggacagtatttctgtaacaggaaagattctcacagagtctattgctgcttttcagataactctcaattcttcatgttcatccttgacagatctcccaggctctggtcagagctgtggtcaggtttccaagcttgggagtgtctccccttccctcaaatgcagcctgttggaaactgaagccttaatcaacatccctcctatagccttctttccttttcttttcttttttgtttagagacagagtctccctccgttgcccaggctggagtgcagtggtgcaatcttggctcactgcaagctccacctcccagattcaagtgattctcctacctcagcctcccaagtagctgagattacaggcatccgccaccacactcagctaatttttgtatttttagtagagacggggtttcaccatgttggccaggctggtctcaaactcctgacctcaagtgatccccaccccttggcctcccaaagtgctagggttacaggtgtgagccactgtgcc

SEQ ID NO: 259469 - DNA, 652 bp, Homo sapiens
gcaatgtctgagaatccaaggatagagagcgtttacaaggcaaatggtgacctttgagagagcagtgtgagatgacgtttggaagcagaagccagattgtaaatggagaaggaattaatggtgactgaagttaagtacagactaacttctgagcaagtgttacatatccataatttatattgttgtaatagtgttgtggaatcaggaggaccagagagaggccttggggtatatacataaggatatctttattgagtgcactcagacccagcagacttaacatccaaagaccgggcccagaacaaagacagcacttgacttttatacacacctcaaaaaggggtgtggaccagcctgaagccggcttacagtggcatgaaagcagggatacagaggcaggacaaagacagttaattaaactgtaacaggttcataactcaggattacacatgaccattgctatgcaacccagatgtccattatctaggtttgcctagtgcctagcacggcttattccatgaccttcactatagcgtccaggtggcctgctcagacagtttatgaccttcactctactgcttagataaaacagaatacctgaagtcaccagttacagagaacaggaattttcataaactcataccataaaaca

SEQ ID NO: 259470 - DNA, 421 bp, Homo sapiens
tcatgtggctccttacctgctgagttttaactcacagaccaaagactcaatgtagggatcaatccaaatttcaagtatgttgatcccaattatagattcaggacctgcacaattgagtcttgggtatgtcagtggacccagtgggctcattaccagccagattttgaccacggcttcattcactactgccatttatttgcccccactctaaaagtggggccctgatgatgcttcagttctccagatataaatgtcaactctagtccttagaccaataatccttgaactgtcggagaattcccttttcttcagtgcacagtcatctatgtaaatagtcactgtggctacgtggtatcaaaattgctgaatatatagggaacataatgtttcttaagcaatataaatagaataaataagtatc

SEQ ID NO: 259471 - DNA, 756 bp, Homo sapiens
catatcacccctactgcaaagcatcactggaatcccaaagaggattccaggtaggctggcctcagtcctgactcttgacttgccatcatcctttctcgtttttgtctttcctgttagtttcttctgatacctcacgtgtcctttggtagaggctgtttcattttaattatttaatttcattttaattatctgccatttactaatgttagtctgaagttggcggtgatttgcagattctcagtagtagttctcatctgattggggggtggtgtctgcctgttttatagatgggacacaggcagagagtaatgtgcttaagataccaatgcctgggaagtaacatgcctaggttcattcctcaagctgtgcgattccagagcttttgctcttttcacaaaaattaactgggagacaagctgtgtccaggtggtgaagctaggtccaggagtacagcccagcatgtactcgaggtctaagttgtacaaaaaaggctgtaagacctttcaaactgatttttaaaataacagttttattgagttagttcatataccaaaaacattcacccttttataatgtactattcagtggtttttagtgtagccacagaactgttcaactgacaccactatctaatgttagaacattttcaccaccctgacagagaaactattagcatgtaagactaattttaaagctaacattattggagtagaagccaaggattgggctctcctgatcatcctgtgaactgagtga

SEQ ID NO: 259472 - DNA, 280 bp, Homo sapiens
tgtgtaaaatatcagagatgaaatattggcagaatttcatttcagtttttatggaaaaggaaaaaagaggttaaggaggattccagattgtgcattagtttattccttcattctagtggagtatgcagaattgaataagacacagactatgctcccaataaacttaaaatttcaaccactaatgttaatacatttaaaaatgaatgacttgctaaatagaagtataagcataactcggggaacagagtaaaatgaataattattattgactaaaaaaaaa

SEQ ID NO: 259473 - DNA, 688 bp, Homo sapiens
  misc_feature (357)..(357): n is a, c, g, or t
  misc_feature (365)..(365): n is a, c, g, or t
  misc_feature (409)..(409): n is a, c, g, or t
  misc_feature (423)..(423): n is a, c, g, or t
  misc_feature (427)..(427): n is a, c, g, or t
  misc_feature (429)..(429): n is a, c, g, or t
  misc_feature (434)..(434): n is a, c, g, or t
  misc_feature (441)..(441): n is a, c, g, or t
  misc_feature (454)..(454): n is a, c, g, or t
  misc_feature (456)..(457): n is a, c, g, or t
  misc_feature (462)..(462): n is a, c, g, or t
  misc_feature (467)..(467): n is a, c, g, or t
  misc_feature (473)..(473): n is a, c, g, or t
  misc_feature (480)..(480): n is a, c, g, or t
  misc_feature (482)..(482): n is a, c, g, or t
  misc_feature (493)..(493): n is a, c, g, or t
  misc_feature (495)..(495): n is a, c, g, or t
  misc_feature (518)..(518): n is a, c, g, or t
  misc_feature (526)..(526): n is a, c, g, or t
  misc_feature (539)..(539): n is a, c, g, or t
  misc_feature (558)..(558): n is a, c, g, or t
  misc_feature (567)..(567): n is a, c, g, or t
  misc_feature (570)..(570): n is a, c, g, or t
  misc_feature (594)..(594): n is a, c, g, or t
  misc_feature (600)..(601): n is a, c, g, or t
  misc_feature (603)..(603): n is a, c, g, or t
  misc_feature (615)..(615): n is a, c, g, or t
  misc_feature (617)..(617): n is a, c, g, or t
  misc_feature (632)..(632): n is a, c, g, or t
  misc_feature (637)..(637): n is a, c, g, or t
  misc_feature (646)..(646): n is a, c, g, or t
  misc_feature (651)..(652): n is a, c, g, or t
  misc_feature (659)..(659): n is a, c, g, or t
  misc_feature (664)..(664): n is a, c, g, or t
ctcttccttttttcgctttctttctgtccttttctctgtcttcctttcttcctcttttccttgcttctttcttttcctctctcttcccttttccttccttctttcattttatttatttatttattttagagacggggtctcgctatgttgccaaagctggtctagaactccccagttaaagcaatcctcccatctcagcctctcgtgctgggattacaggcatgagccaccaagcctggcctctttttctttatttctctctttccttctcttcctctctttctttcttcctttctgtcttcctctctttttctttttttgtctctctctgcccctctttttctccctccctccctncctccctnccttcctcttccccttccccttccccttcccctccttcccttcnttcctctccccctntctntnccctnttccccntcccccctctccncnncttcnccctnctctcntcctccncncttcccccctncntcccctcccccctcctctctctntccccctncctttctccctcnctcctcctctctcctcccnccttccccnccnctcctcttcctcctctctccctcnccctcnncntccctctctccntnctcccctcccccctncttcncctctcttnctctnnccctctncctcntccctccctccctccttcttctcc

SEQ ID NO: 259474 - DNA, 678 bp, Homo sapiens
  misc_feature (357)..(357): n is a, c, g, or t
  misc_feature (365)..(365): n is a, c, g, or t
  misc_feature (409)..(409): n is a, c, g, or t
ctcttccttttttcgctttctttctgtccttttctctgtcttcctttcttcctcttttccttgcttctttcttttcctctctcttcccttttccttccttctttcattttatttatttatttattttagagacggggtctcgctatgttgccaaagctggtctagaactccccagttaaagcaatcctcccatctcagcctctcgtgctgggattacaggcatgagccaccaagcctggcctctttttctttatttctctctttccttctcttcctctctttctttcttcctttctgtcttcctctctttttctttttttgtctctctctgcccctctttttctccctccctccctncctccctnccttcctcttccccttccccttccccttcccctccttcccttcnttcctctcccaacacattatttaacacattctctcatcacacaccccaataccaatttaccttttcaaaccaactatcaccatacctaactcccccaccacaaacacatttaccaaccaccaacccccattctcacaaaatcattcaatcctcttctcacccacaccctctttccttaccatattcccctacccctttcacctcatcccccataacattttcctaacttctcttccatccctccctttttatcttccctctccttctcc

SEQ ID NO: 259475 - DNA, 442 bp, Homo sapiens
  misc_feature (357)..(357): n is a, c, g, or t
  misc_feature (365)..(365): n is a, c, g, or t
  misc_feature (403)..(404): n is a, c, g, or t
  misc_feature (438)..(438): n is a, c, g, or t
ctcttccttttttcgctttctttctgtccttttctctgtcttcctttcttcctcttttccttgcttctttcttttcctctctcttcccttttccttccttctttcattttatttatttatttattttagagacggggtctcgctatgttgccaaagctggtctagaactccccagttaaagcaatcctcccatctcagcctctcgtgctgggattacaggcatgagccaccaagcctggcctctttttctttatttctctctttccttctcttcctctctttctttcttcctttctgtcttcctctctttttctttttttgtctctctctgcccctctttttctccctccctccctncctccctnccttcctcttccccttccccttcccctttaactacctnnctacatacctacaccatttcaatcccttcttctnatct

SEQ ID NO: 259476 - DNA, 472 bp, Homo sapiens
cgttttgcatacttaaacttatgaacacagaaatcatataaaatcattcttggcagttcttctcttgaccagaatgacacatgccatgatgatcttatcataacgtgcagcaggaagtggctaatgaggtcatcctagcaactacaacctcgtcaaagaggcccatattttctggtgaaataaggcaaccaatctattcatttagctcagtctctcttttcatctaagttgttatcacaaaattcccaagtgttgggtttatagccacagattcttccttcaaatgaagtaggctcgtgcaattgtctattcttgtaaaagctgctactaattttgtacttcctcatattgacctcagaatcatcctgaaaatgattctctgccctcgtcctgaatatgggctcagttgatgaagaaaaatacaatttggaaaaaaacgattcaggacatctaaagagactgagctgacaaa

SEQ ID NO: 259477 - DNA, 739 bp, Homo sapiens
ttccatgtggctggggaagcctcacaatcatggcagaaggcaaggaggagcaagtcacatcttacatgaatggcagcagggaaagagagaacttgtgcagggaaactcctctttttaaaaccatcagatctcatgagacttattcactaccgtgaaaacagcacaggaaagacttgcccccatgattcagttacctcccaccgggtccctcctacaacacataggaattcaagatgagatttgagtggggacacaactaaaccatatcagttatcaacttcatggtttgtccatgattctcctagttttagcactgaaatttctatgtttcaggaaacctctcaatcctgggcaaactgaggcacttgattaagagacatttgattcttgctttataaggttgttcatgagtttcacttccaaaaagcaaaatgggtttccagacagaaaagtacatggattttggagtaaggctcaacagggtttgatatggtttggctgtgtccccactcaaatttcatattgaattctaactcccacaattcccatgtgtcatgggaagaacccagtgggaggtaactgaatcatgaggccaggtcttttccatgctgttctcatgataccgaataagtctcacgagatctgacggaattataagggggagtttccccacccaatctctctctctctttgcctgccgccatccacgtaagatgtgagttgctcttctgccatgatt

SEQ ID NO: 259478 - DNA, 513 bp, Homo sapiens
ggcctggctcaccagctcaggtgggccagtaacagaaattcttcaaaacagactgttgtagctgagaacagtggctgtgagctccagggttagaaaagcctgttttcaagtcctggaattgccacatattagctgggtaactttgggcatgacatttactctctctgaatttcagattgcaaaaactcattggattgttttgtggattgaaagaaataatgtaaatttaggccgagtgctttgacttacgcctgtaatcctagcactttgggaggccaaagcaggagggtcacttgagctcaggaatttgagaccacccctggcaacatagtgagatcctgtctctacaaaaaattttttttaaattatccagcatggtggtacacgcctgtattcccagctactcaggagactgaggtgtgaggattgctagaacctgggagatcaagtcaacagtgagccgtggttgtgccactgccctccaacctcagtgacagaggaagaccctgtctc

SEQ ID NO: 259479 - DNA, 457 bp, Homo sapiens
gctccttctgtttggcacttagtaagatctgaaagtttgagggttgggatggtggattttttatttttatttttttaaactaaggattgtgaaggctgtccagatttgtcatttggcagttaacctggtcagtcagcagtatctggatactaaagaatccttagtggtagactgtgtgcaaatgaaagaaacgttaagtccagtgaatttgactaggggtggaaacttatgctccgcagctcttcatggtgacaaggaggcaggagtgccagggtcaagggttacaagtggactccagcattggcgccaggggaatttgcattttatggacatgtaaaatttcaaatgggacaagtaggacctgccatgggttgtcttactaggtgaggattgctttttaaaaggctgcctggtttcccccttatttattaaaagtgaaagaatattttagtatcca

SEQ ID NO: 259480 - DNA, 586 bp, Homo sapiens
gagaggctgaggcaggagacttgcttgaacctgggaggcagaggttgcagtgagccgagatcgcaccattgcattccatcctgggtgacagagcgagactctatctcaaaaaataataataataattaatttataatatatcagtatatataaagtaagtaattcaaatatgtctaacttacttccaaggagtgtctaatttgaaatatgtaaaatttgatagatcagaaagtttttttgctgtgtgacttttcaatcatttattaagatttcagtgcattattatctgggttccctttaagactgtaagaaatgttagacaattttagcttattacttataggatgagaagagaataagagtggttgatgggactaaataaacaatcttaaagtaataaaaaggaccgaggagtatgactaccccaattttccatatctgaagctgagataaaaaattaatcaggtttcctgggttacatatctgtttacccactaactacattagtgactctggacattttattcagtggtctctaccccataagagtattgtaaaaattagatgaaataatcatgtaaatcgc

SEQ ID NO: 259481 - DNA, 504 bp, Homo sapiens
aaccaaggaaataaatactctgacctccttatcctcctgctgcccagtcttctgccagttcctcccacaaactaaagccactgaaagccagagagcaagggagcccattaatgtagtccataaaggtcagcctcctggagcgtggagcaggctgaagaagggtgggaaggacatctggagaggccagtggagaatatccagcacataaaatacatccctgtttttatacttctctttggcagttcttagtattttaaaaattataaagtggaaacctcaaaaaacaaaaggagtactgaaatttattaaaaacttttattttaaaacatgttcttaaagtcctaaatctgtcccccttttacatttagttaatgtttgcattctattccatggataggattacatttcaaatggtgccaagtgttcatgtgattttagcatattaattcaataaaattttaatatttgtaaaaagggtattttaaataaaagcattattttaaa

SEQ ID NO: 259482 - DNA, 4889 bp, Homo sapiens
cttattgcactattgttatttcaattttacagagaaaaacaggcatagagtgatgaaatagcaagtacatatataaacaacaaatggcagagctggaacgccaatcctagcaatctgaaccagcatttaaaaacgaggaattaaagcacatagggtgagaaaaattatagggaagggacaagagctcaaggggacacctggaaaagaaatactataatttaaaaaattaccaacgggctaattatacttgtgttttactggcagagcgctttgtctgttagctcttttaatcccgctaataattctgtgaggttggtactataagttccatttttcagacaaggacgcttaatagatgataacggacacattccctgcttgctctgatctgcatctcaacagctggctctggagcaagcaaagggagactaagggaaacagagcggagcagggcaaagaaagccgactgaaagtgagaaatgcaggaaatgtttcccatctaggcagaagctggttccagcattcaaatctctccagccggcccgccaccacgtcacaaagcccgcctctcagtgacaaagccccgccccgttcccttggctgttctctgagctcccaatacttccctccttctctttggcccctgctaccccgcctagcatcatttcctgtgcgctggatgctgattggtccgacagtcggaagtgagggcgggcggtgggggccgttgccgcagtgacagtgctaggggagtccgaagatggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacgttagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggccacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgaaaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtg

SEQ ID NO: 259483 - DNA, 598 bp, Homo sapiens
ctgccacaatttatctagaagatctagacaagacaattgaaggtggctatagcacacaacagattttcaacatagacaaaacagccttttattggaagaagatgtcatctaggactttcctagccagagaggagaagtcaatacctggtttcaacgcttcaaaagaagggctcaggtcagtggcttatacctgtaattctagcacttcaggagaccaaggcaagacgatggcttgagctcaggtgtttgagactagcctgggcaacacagcaggaccctgtctctacaaaaaattttaaaaagcacccaggtgtggtggtacacacctgtagtccaagctatttgggaggctaggcaggttgattacttcagcccaggaagtttaggctgcagtgagctgtgattgtgtcactgtactccagcctgggccacaaactgagactctgcctcaaaaaaaaatgcagctggtgactttaagccaatactcactcaccattctgagaatcctaaggcccttaggaattatcctaaatctactctgcctgtgctccataaatgcaacaacaaagcctggatgacagcatatcttttgacaatg

SEQ ID NO: 259484 - DNA, 442 bp, Homo sapiens
aaaaatgcataatgacactcacagcctatgatgtgtcggatgtcctgtgctccaacatggctccaccatagccctggcattgggcatccctggatccatttttacatagaaggaagctgccaaggggcagacctcagatggcagtgtggatcagtttgaccacattgtctctgcagtctctttaatctaatgtgtgtctgggagctccagggttttgaatgggtctccattttccaaaatgtgggcatgccttgtggttcattcagagacaaccaacagatgggccaagtcaggatggctttgtgatcaggaacatggcttggccattagacagcctgggctcaaatcccagggggattatccatgagtgacctatccttagaaaagctacctaggtgaaggactgtgcttcacacatgcctggcacatgcaggaagctctt

SEQ ID NO: 259485 - DNA, 726 bp, Homo sapiens
actctggggactctgcctcttagcaaatcaacacccaattcctgggaacatttttggtgccttctgctacctcctcttcagggatggctgcagggcactttgtcctatgagtcggggtggagaatgtccagtctcctcccctcccaatcacttcctccatcatccaggtctccattcaccatgttacttccttcacttctccttgcccaatccctcccacaaggaagcccctaaaacaggttcccagatctggtccccagcatctgcccctcacaccagggcctttcaggaagatgagttctatggctccattctctctgactccagattcaccacactgaaaggcagcctctagaccagccctggatggattgcacaaactggagactgcggaagacctctgccaaggaaagcctggccctccccagtcctgtctgccccctctgagccctgtctaagattacagcccatggcccttcctctccttcctttcccagagcaagagccacagcagttagcccatgacagtgccagagacagccctggcctggggaaccaaggaccagaagggaagaccaggcctctagttcctcggcaccagacctgacccagccaggcctggagtgtcaacatgagtgtgaatgtgagtgaaagggtgaacgtggtgaaagcatagcttttgaactcccagactgcagtgcttccaataaaaccacctagcaccca

SEQ ID NO: 259486 - DNA, 538 bp, Homo sapiens
aaattttcaagggaaggggatgaaaaaatggcatgctttggagcgaaattgcaactggggatgcagcatagtatttccagaaggatccagaaacaaagtgtcaaaatctgtattgtaagaaggctggtgctcctgaaatctagcaggcaggtgcttactagaagtcacaagttgttcatttctgtcttcaacatcatttgatactatagacttattcataaggtcaattgcctagtcaggcttatgcaatgcagtggatagattctgtaatgttggaaagattctgtgggatggaaagattctgtgggatgcaaaaagaaactgtgtctctgatgttgccattttcaccccaggatgatttgctttacaacgtgctgtctgcaaataagtttgtggttaaaattttagtttactccccatgatgtgctattcatctagtttcttctcatcaggaattctggatttcttatttgcctcttaaaaagtaaaacttttaaaaaatttatgaaaatataacctcatttaacaagttcattga

SEQ ID NO: 259487 - DNA, 335 bp, Homo sapiens
gcaagccggagtcctcggctggagtgggccccaggacacctccttgcctttcaagccctgagagcctcttccctggcttcttaggaaaacctcctggcaggtctctaggaaaagcagtagctcccctcccccagccccaccttccccattccgggccattgcactaacttcctcctgagccacccgaggcatggctcccacctccccctgaccaactggggagcttccgaacctggcagatcctatcccaccccaatatcctgttagatcagactcagccgtttaaaagaaaaatatcctttccactttccataacatttcctattggaattgat

SEQ ID NO: 259488 - DNA, 433 bp, Homo sapiens
tgagatgtagcagacagcaactcggagacccgcagattcaccaagtagacagaagggaagtgggtttccttctctgtcccatcgggaagagaacccaccagaatatctaacccagacccccaaatgccattctgatttctggctgtgctttctcccgtctcccacaatagccgttgctttcagagaaataccttctccaagtcagaccccctgcccttctcactcacaaaacccttgcattgaatctggtgacacttctccccctgtgaagcggcaggactcacctggaagttgttctggtctttccctctggacagaaggtcctgaaatcgctcaccaggcgttttttgaggtctccatcactcagccaggaacctcaaaatctctgtgaattcatctttctcaataaacactcttgctagccctgtcttga

SEQ ID NO: 259489 - DNA, 207 bp, Homo sapiens
ttttttctggtagaaaatttaacaggatcttttgttaggcaaagtaaatgagactggcttaggttatgaactagttttttttttccccaaaaaatgtttatttttgttatattattaaagccatacccacccatacaaattttgtttttaaaagcaggaaaaaaattcacccataattctaacagtccaataaaacctgacatttag

SEQ ID NO: 259490 - DNA, 2701 bp, Homo sapiens
  misc_feature (2672)..(2672): n is a, c, g, or t
  misc_feature (2687)..(2687): n is a, c, g, or t
  misc_feature (2694)..(2694): n is a, c, g, or t
cccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctccggattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagccctcctacgacgagatcttctacacgctgtcccctgtcaacggtaagattacgggtgccaatgttaagaaggagatggtgaagtccaagctccccaacaccgagctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaactgtgaatttttgtctccccttcccaccctccaaccaaggaacaaccctgcccagggggntaattaaggagtggnataacgngggggga

SEQ ID NO: 259491 - DNA, 2567 bp, Homo sapiens
  misc_feature (2538)..(2538): n is a, c, g, or t
  misc_feature (2553)..(2553): n is a, c, g, or t
  misc_feature (2560)..(2560): n is a, c, g, or t
attctcaccagcctggacagccaaaggggtctgtgtgtggccggggaggatggcgggggagtgagccccatggaacagccaggaactgcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagccctcctacgacgagatcttctacacgctgtcccctgtcaacggtaagattacgggtgccaatgttaagaaggagatggtgaagtccaagctccccaacaccgagctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaactgtgaatttttgtctccccttcccaccctccaaccaaggaacaaccctgcccagggggntaattaaggagtggnataacgngggggga

SEQ ID NO: 259492 - DNA, 425 bp, Homo sapiens
gttgaacctgctgatatgtcagatgctgttaccaaggccagcaagtgcagatggggtactaattctctcacttcggaggaggatgactctggtttatgtagccctccagcagagagggaagaaaaacagggcattttaactggagaccagtcacgaattaaaagtttgtcttctactgaagatattcttgtaacagaccaatacagaccatttttttctgttaattccattagcgaacagaaaatcccactgctttcatgtcaaagtgcccaccctgatgaaaatttcaaaatgattttacatgatgtttctccactagaggaagcaaaacatgtaaatggtcaaagggaaatccacgatgaaaattgttgcctgcagaataatttgaaagagagccctgtgaagtgtgacccattaattatgcc

SEQ ID NO: 259493 - DNA, 433 bp, Homo sapiens
tttcattttttaacatttctttgaaacacttactacattcaatgttacagtatttctttttttttttaaactcctatttacttagaaattattctgaggctaaaagaaatcaagtgcgatttcttttaagggataatttattaataattggttatcccactagttttaaaggtcttcacatggctgtcttcaggaaagaggcagggcagtagaagtagaggtgcaggtactaaatttgtgaaggcatgtgaaggcaaattgttatttagcatagtggtattcattatccatggtcaaggtgtctgaaattgctcattaatcaatcattaacaaccacagaaaataggggaatttcatggaagcgtaaaggttcactggcagagaaatttctttatgacttgccaagtaaaaggaatgtgaagaataaggccaa

SEQ ID NO: 259494 - DNA, 279 bp, Homo sapiens
gtgtgggtgatctagaggatccctgatatgtgtcttcaggaaagaggcagggcagtagaagtagaggtgcaggtactaaatttgtgaaggcatgtgaaggcaaattgttatttagcatagtggtattcattatccatggtcaaggtgtctgaaattgctcattaatcaatcattaacaaccacagaaaataggggaatttcatggaagcgtaaaggttcactggcagagaaatttctttatgacttgccaagtaaaaggaatgtgaagaataaggccaa

SEQ ID NO: 259495 - DNA, 298 bp, Homo sapiens
ccaaagacttcttggtcatctgataaatttaagattcttaacataaactttgctccctctggaaacctcacagctaaaggtaaaagtgaagataccagcctggacaacatagggagacccaatccctaaaaaaatgttaaaaaattagccaggcatggtggtgcatgcaggtagtcccagctactctggaggctgaggtgggaggattgtttgagcccaggagtttgagattacagtgagctatgacgacgtcactgtactccagcctgggaaacagagcaagtgagaattcatctaa

SEQ ID NO: 259496 - DNA, 481 bp, Homo sapiens
aaactcttggaaaaccagagctatgaagatatttcatatttccccaatatgacaaaagtatatgaagtgtgtgtgtgtatgtgtgtgtgtgtgtgtgtgtgtgtgagtgagagagagatagagagacagagagagagagatggatatctatctttccctcaatgtgggcctctcttagggttctgccttcgttttccacataaacatacttttactgtagttcattctatttccatttctttcaatactatttatattgttgggaaaagaatgattcccaaattagtcatcgtattaaaactcatctctgacatccagataccagtatggaactattaactttatagctgagattggatgctttctatttatgttcaaaactaaatggctgaatctttcactcccattttcatcctactgtttttctcacgtcagtaagttattgccacatctgttcagttgtggacattcttgataaaat

SEQ ID NO: 259497 - DNA, 209 bp, Homo sapiens
tgaggaaggtcactttatatcttagaatgtgccaagaggtagttagttgagattttatccccaggacagcttaattcatatcctgaatcatctacaatcagctcacctttataggtgagtggacaggtggtaagagggtgagtagggttaggaggtgggaagggtcatgagaaagaagggtgcatgggtggaaggtgagagggtatggg

SEQ ID NO: 259498 - DNA, 360 bp, Homo sapiens
cggagaggccaagaagaatctgaacagacagactgggtctgttctcagtctattaccattggatcttacccttttgtccaaccacatctacatggctgcccactcttcattgaacctaagcacaaaaatggacagagcgagactctctcaaaaaaataaacaggctgggcatggtggctcatgcctgcaaccccagcattttggtaggcagagccaggaggaccccatctgtattaaaccagagagaccccatctctattaaaaaaaaatagacaggtttccctgggtttttccgtcttcatttctgaaggttcccatgtcacctaaaactttgattaaacaaatgtgttgtgcttttct

SEQ ID NO: 259499 - DNA, 758 bp, Homo sapiens
gttgggtcacccaagaaggcgaccagttcaggtagctctgcataaagagaagatgttccaccctgcagtccttaccttaaatctaggcagctaccttaagaattgacctagacagcagtgtgtgcatggctcagtgcaaatctttagcatcacctggtagaagacaacactgagcacacagtcgcagaactagtgcagttcgaggtacgtggaaatgtctctgcaaagtaatatttctggtttcttgtttttttgtctacccttttcccctttactgcactatatggtgaaaaacgaaaacaagaactgctaactacctgatttccgaaacaagaagtgtgatctcaaatatttctgttgatctcaggtttttcatctgaaaaatgaggatgctggtctcaatttctaaggccccttcctgcccaaacttaccaggaggaaagaagctggaagtagaaagcaggagaggttcaaaaagaaaatgggatgcatctcctttagtaagctctactctggagaaggacgttgtccttcaagtacaaaccttttcaccgacttggggagtttccccccattgtatcccaccccatctttttctgccatcgtgcactgtgtcgtttgaatgtgctgctttgtcagggctgggggcttccttggtgctccagcttggccacatccgacacacagaccaccccgtcctccttctgcctctagaggaccaagaacaacccttgttctgaaagcaccctgtccctgag

SEQ ID NO: 259500 - DNA, 421 bp, Homo sapiens
tggaaagggcgtctttcagggtgggggaggtggtggggaggagcctgggtgaactcctgactgctcagcaccaacattgccatgggtcaagactgctcccgacacctccatcctggggcacaggctgtgcatccagaaactcaacccaagctgctgagacgccatcacccccactcacttccccagactgcccttctggctgctctgtggcactcagagccgcgactgttctcaaactgctgtctcccgcttcccttggttttattgtgatcactcctctctctgcagtcctactcttattagcaatcaactcaggactgccatgaaaaaatgtttcctgttacctcacacatacagcacttatgttaaaaacacttacataagatgaattctgtaaataaatgttcgaggcatgtttgta

SEQ ID NO: 259501 - DNA, 565 bp, Homo sapiens
caagcagttaatacagactcataacgtataaggaaatcaaatgtaccatgagctaattactataaacaagaatgaaggctgggtgggtagctcatgcctgtaatcccagcactttgggaggatgaggcgggcagatcacttgaggtcaggagttcaagaccagcctgaccaacatgatgaaaccctgtctctattaaaaatacaaaaattactcagatgtagtggtgttcacctgtaaccccagctacttgggagactgaggcaaaataattccttgaacccaggaggtggaggttgcagtgagtctgtattaactgcttgcaagcagttaagacagactcaaacaaatcaacagggatatactagtggaaaacacaatataaaactaaaatgccattggcttctttaatgggttaaaagcaaaaatgtaacaggcagaaagtctgtttcaaacaaattaaaaagctatgtgttttttaaattcttcccaaatcagatatatacacacccacaaaaatagtgtgtgaaggaaagctgtcatacacaagaagttgttcctgaattc

SEQ ID NO: 259502 - DNA, 475 bp, Homo sapiens
tcattgtaatgaagaataactatgagcataacagcttttctgagttctgtgagtccttctagcaaatcattgaacctaagacagtcaaattgccttaatagaacatttgcaaatctggcttttaaaaaattcatttcaagtgcccatcaaaattaactttatattttcattgctcttgatttacagaaaatgtatggggaatactaagaatcttcacaaaccagctttttttcttcccttgcagataaggacttaaagtgccaggcctttattaaattctctaggtttatgtccatattaatgtatccaggcctcataaagaccctaaagcactgatataattattgtttacattctacaacaagaaactgtaaagcggaaaaatgagtaactattaacccctttgaaatgcagtgtgaacatataactgaattttaaatttttttcacttttcctaagctaattaacacaggat

SEQ ID NO: 259503 - DNA, 347 bp, Homo sapiens
aatgcttgctcattgtccaagcagattagatgataaacccactggcacagagcttattaaataatctctgactagggatatctttaattttggattaggggtggggctgaatctacagatgaaaaataaatggctcaaaataagaagagtagtggaagggagccaagtgagtcattacaaatggaagactttgtgaatggttctagggaatagaagaatagattttgaaataaatgttagaacaccgagtttctattggttttacacctgttaactctaagacagaaatgatttggctttgacatggttgtgcttctttcttaaactgtagggtacttggtcatatg

SEQ ID NO: 259504 - DNA, 872 bp, Homo sapiens
tcacaccagcatcaccacgaatataagtaataagttgtgctgtgacataatgacggctatgatgtcactagacgataggaacttttcgctccattggtaatcttcctggaccactaatgtatatgtggttcctcattgaccaaacgttgttatgtggtgcataacagtatatttaaaatacataataatatataatattatagtggtgcatgaatgtggcaaaagccatgaaggtggtttgagaatgactaaagtttgagtaacagtgatctagtctaaatcatcctttttagatgaagaagtgagtttagcaatggtgactgtttctggggttttctaatttcaagttccctttgccttctaggaaaagcttataacatcagtatttcccacacgaatttacttggccacgtagatagttccagagtgttaagtgcccagtggaaatgaaaatacttagcactgccctccgggaccttatagatcaagcatagaactcataaaaatggtggctgggttgaaaattctcattaatacacagtcaaaggattattttggttttgcttttttaaggtgatggcttttttggtcaacgtgatgttttataaatgagtaatgttaggccaggtacaatggctcacgcttgtaatcccagcactttgcgatgccaaggtggtagatcacttgaactcaggagttcaagaccagcctaggcaacatagagaaacctcatctctactaaaactacaaaaattagccgggcgtggtgaggaggcgggaggattgcttgagccaaggaggtggaggttgcagtaagctgggatggtgccattgcactccagcctgggcaagacagcaaaactctgtctcaa

SEQ ID NO: 259505 - DNA, 301 bp, Homo sapiens
atgctctttgctgtatgttatactccagttgaaggcaggagggagaccgacctgccacagaaacctgcaagggtgtactgccacatcgttctgaaacccaagctgcaattgtacaaatggctcaaaatcccttttgactaaaggataaagattgaaagcaaaagacgtattttgaccaagtgtggagggaaaccaactttgaatgaaacacgaataacagataagatagtgaagaaagtgcttcactgtgattctcttaatagtactcaataaaagtatcttttaagttttagtatttctt

SEQ ID NO: 259506 - DNA, 827 bp, Homo sapiens
caaacagcattctcatgagttaagtgtaaatgagtcagaaacacatagatcaaatttcttttaaaatacacatgggtttgaaaattaaggccaaagtgcttggcaaaataagttttggttttatccaaacccaaatgttgaaaaaataattctaagatttgccaaaccaaaaatacatgcagatctcttcaatcctcccattaaataagatggcatcataaacatgggacttagtggctattttcataatccccaaggtttaggcaacatggaccttaaatattgattgaaagactatgaaaaatttttggtggaaaaacattataaccttgcaaatgaagatgagggctactggttcagggttctcatcctgattttgacagcacttctcactgtccgatcaggtgatcaacttgtcctttgtcttagctctgggtgtgtgtgtgtgcatgtgtgtgtgtggcctatgcatagcaataataacttttaaaatcctatttttggattttataaatcctaaatgtatacttaattcatatattacaatctgcgaaacttaataactcctcatcatatccaaacagagggaagcagtccccttttgctcattcatagttcagagatagtcttcatttatttccctagagggtaaaacatatccattttgcactaacaatatctaatgctgactttgctcaggtctgtgttattaaaagatgagagagagagagggaaagagagaaaagaaaaaaagtaggggagggtgtgtggcaggagtccttgacttgatttgaagaactaataacctactgagagacaaaaaaaaa

SEQ ID NO: 259507 - DNA, 130 bp, Homo sapiens
gaatttggacatacattttaacaataagtacattgattaatacatttaagtttataagtaattattgaggatccagtattttcaagaccttggcctagtttcttttcaattcaaagatgagttgcaaaag

SEQ ID NO: 259508 - DNA, 499 bp, Homo sapiens
ggaagatggggaaggtagttgacctcctcagtctcactttttccagtgtagaaaccatgagttgggggagggccattgcagatgtggaaatcagatgctcttaccatctgctcagagttttttcatctctctgtggccccaggaactgtctcattgtcatatttgagttctgggttgttgctgatgaaaatctcagcactgtatatttgttttgggttttctgtggaggggagtgaagccagcttgcttctataccactgttttgaaactgaaagtattccttctttcccttttttcctgtggtggtacccttattttgaggagtatgaacatagaattcatccattcatttgacaaatatttattgagtacctcctttgtactagactttgtttaaggctctggagatacagcggtgactaaaacagataaggcccctgtctgaaggagctcatatttgttctaaaatggcaactcctaaagtggcaggtccctgaaa

SEQ ID NO: 259509 - DNA, 297 bp, Homo sapiens
gtaagattttccacatctgcagacaaaaggaaagttggggtagtttaaaataactgctgcatgtggttctttctgtataatttttagttttttttcttctaaaagggtgttagaaaatattaatctttttgttgctttgaggtcttatttacactaactttacctcttcttcatagattaatttttcattctaaatgttgcattcttcaccgggaagttaaataaccaaacccagaatcactgcaacttacctgtgatttagaaatagagttctggaaatcatttaacaatctaaaa

SEQ ID NO: 259510 - DNA, 367 bp, Homo sapiens
ctattaatccattgtacatgattaatagtaatagtcttgaagggtcttcagcattggtattatgttgtccattaaaggcaaactgaataaaaatcaacccagagatgatagttggcattcatttacgacaggtgagtatccccaagtaaagattttgagctgccagaatggccatcctatcacaatgctgggtctggggagtatgatatttaaaggcagggccaaggtttccaaattagacaattgttcatttcttctatacaaataaatataaaatttggggatctttagcaaacatatctacaaagtgtggttcagatttttaaagaaaaagttatgagtgatacttctgaaccatagatggaaa

SEQ ID NO: 259511 - DNA, 452 bp, Homo sapiens
gcaaaggaccccatcataaatgctgtgtaaaaactcttaataatttcatgataaagagaaaaataaccaaggaatattctcattagcaattattcgtatcttattaagcatgggttttttattctcattttgacagttcatgtgctatttttgcatatgtgtgtgtatatccacgcacatgtacacatgtatgcacacacgtagactcactgcagggtcctgttattaaatcactgttggcagatggcaagtcatcaatagatgcttgttgaattgaaaatgataccacatgtaattgaccttctgtaacaatttttttctcattttattctaattgtaattggtggagggatttttaataaaattaacatggtcccttacactaagctggagaacttttctaatctattggcagtaagtgatggatttgaaatttattgcagaaggattgg

SEQ ID NO: 259512 - DNA, 431 bp, Homo sapiens
tgaggcgggagaatggcgtgaacctgggaggcagagcttgcagtgagctgagatagtgcctctgcactccagcctgggtgacagagctagactccatctcgaaaaaaataaaagaacttcccgtgtccgtttttgctttttggatgctgggagtgtcacaactcagctatccaatcaaggcagagctggcctccaggatgccagagccagagctttgtggttcatctctagaggttcaacaggaccctgtggatggcccaagttcgtttctctgcacttacctcttcggggttgtcctcaaaacgttgccgtgtcagctctcacttttcacagcaactctggcctcctaccttggactgcgccacttctgtctccttagataacctccattcgcatagctaaatgctgcaccctccgacactgccacaata

SEQ ID NO: 259513 - DNA, 226 bp, Homo sapiens
tattgttgttaaatacagctgctttattcttacatgtgatgcaaaatacaatgaacagttaatagtttatacgaagtgacttacagagtgacaaggagaccagttcacattcagtggcaaaataagaggaaatcaaataaatatcaagacaatagaaaattatttattgaaactagaaaaaaaataccctaacagtcactattcagcaacccatagagttgagaca

SEQ ID NO: 259514 - DNA, 370 bp, Homo sapiens
ggcttccagatgcgtccgccacctgccctccgtgccacgcgcttccccctacctaggggagcctccaccagacagggaacccacgccttgccacccttctctctccctcccacttcacctgtccgcgtcatttctggagccctttctttctggcacgagatgctccagggccctgttgtattctccctgccccagcctgaacccagctatttctgctgcagcctggttcattgtgggagaatgtcatgcagagcccgggatctggctccggatgtgctcattgctactggggtgtcattgcagctggcggagcaagggaacacatctatgtacatgcccacacgcatatgtatacacacagtttcatggg

SEQ ID NO: 259515 - DNA, 133 bp, Homo sapiens
cagcagaggcggatgctttaggagggacccccgtgtcgtgcccaccctctaacaatgcaagtggacgccagatgttccatgcagaccgcagctgcggggcaggcccccatctatctgcaatcccagggtaatt

SEQ ID NO: 259516 - DNA, 348 bp, Homo sapiens
tttcttctttttaagagattatacaatttagttttgtatttttgtaatgatttttttcaattgacaaatgttagctacatgtttttcaataatcatcctcttatctgagttcatcactaagagagaaaaattgcttcacgttatcttgagtaacatttggatgagctatcagtcatcaactgaaattaacctgaacatgtctccaatgacatgaagaacatttaagcatgccagctggaaggcatttacagtttcatttttccagcttccacagaaaatctttcccatgcacatctgtgaaggttttataacgattagactgatgtgagctttgtttggcattagggc

SEQ ID NO: 259517 - DNA, 449 bp, Homo sapiens
ccgcctcagcctcttgagtagctgggactacaggcgtgcactaccatgcctggctatgtgttttgtttgtttgtttgtttgtttttttagtagagatgaggtctcactatgtgccgaggctgatcttgaactcttgagcacaagtgattctcccatctctgttgggaatataggtgtgagtcactgctcccggcctcttcacatattcttgatctgtgtggatttattcttttttttttttaatacggagtttcactcttgttgcccaggctggagtacagtggtgcgatctcggctcactgcaaccaccgcctcctgggttcaagcgattctcctgcctcaccctcctgagtagttgggattacaggcacccaccaccacacccagctaattttttgtatttttagtagagacagggtttcactgtgttggccagggaggtctcgaac

SEQ ID NO: 259518 - DNA, 446 bp, Homo sapiens
tttttcatctagacaagtttgttcaggagaaagctggagggggagaagtggtatgcttgttcactcagcaactgtttactgggtgaggatcccttggttcttgtaaggatgaacctgaagaaggttttgggcatgggagtgagccccaggccatgggtgttttgctctgacccttaagaagtacagggtgcaggctgggcacagtggctcacacctataatcccagcactttgggaagccaaggcaggcggattacctgaggtcgggagttcaagaccagcctaaccaacatggagaaaccccatctctactaaaaatacaaaattagctgagtgtggtggtgcatacctgtaatcacagctacttgggaggctgaggcaggagaatcacttgaacccaggaggtggaggttgcagtgagccgagatcacgccatcgcactccagc

SEQ ID NO: 259519 - DNA, 660 bp, Homo sapiens
gaggctcagagagaagtttactcattgtgatagttcatcttatgtgtccagttggctaggatacagtgcccagttgtttggtcaaacaccagtctggatgctgctgtgaaagtatttttcagatgagcttaccttttaaactagtgaactttgagtaaagcagattaccctccaaaatatgggagtcatccagtcagttgagtatcttaagagaaaagacaggtcccctgaagaagaaggaattctgcctcctgactgcctgtgaattcaagacttcagcatcaactcctgctggaatttccatcctgttgacctgccctgcagatttcagacttgctaggcccacgcaactgcatgggtcaattccctcaaataaatctctctctccttacctctctctatgtatatattgagatgcagattatagataggttatagatctaggtacacatacacggtactctctattggttctgtttctctgaataatccttactgatacattcatcctttccctcatgaagcaaataattattaggcacctactgtgggctctgttaggtaaagcaaataagacagggtctctgccctcaggcagggaatagacaagtgacttcccacatacaatgtagcgcgaccagtgctctgagtggggtgtgc

SEQ ID NO: 259520 - DNA, 662 bp, Homo sapiens
gtagttctcaactggggaaacgtttgctctccagggtacatttggccttgtctggagacattttttggttctctcaactaaggacagtgctaccggaatttagtgggtagaggccagggttactgctaaactcataatgcacaagacatcctcctgtatcaaagaattgtctagaccaaaatatcaataatgctaatgctcagaaatcctatcacaggacgatttattcctcaggaaccctattgtctctcctgatttggcctctatggaaaccattcttgtctataaagcaaatttctttatgtctaaacaccaaggtagagagaacttaagtcttagtcccagtccttgacccttatgtaacacagcagataaaaataatcatgtattaaggacctttcctaattcttttatctgaagtttctaagctttagcccctgctcatttgagctattacatggaaagtaactcacagcatattctttcattcaacaaatatttaatgagcacctactatgtagtagacatggtactagacattagatacacaatgattaaccaaacagactattcccctgccctcatggagcttacagtatgaaaaagaacaaacagtaaacaaataaatctataattacaaatgctaatgcatgccatgaagg

SEQ ID NO: 259521 - DNA, 440 bp, Homo sapiens
ctctctctccttgggcagcgtctaaatcccttgcatggcatttcacacttactaatttatgttactgtaaatacattgtgctcttgtttgatctccttgcaaaaatgtaaactccttgaggtcagcactgtggctatggtttctctgtggccctcaagagagaaaagaccaaattagggcagtagtctgagtcctctggaagtgggcctttgggtttgtctttgctttggactggatggatctccatggggcccgactacttctgaactgtggagtttgagttcctgggtgaaaattccaactctactgcttgctaaactggactgtcacttaagcctctctgggtcttggtttcctcatttgcaaaatgggggtaatagtagcccctacctctcagaggtatcatgaggatgaaatgaattagtgtatttgttttgaat

SEQ ID NO: 259522 - DNA, 411 bp, Homo sapiens
caaaatagataattaagggaagcttacactgtagttgggggaaacagtccataaataagtaattgaacaataagcaagatactgtcagaatgaaaccaggatcatgaagaaaaggaatcagaatgatttcaaaaagcatttgagggcaggggaacctgggactcttttaatgggtgcacctaaaagagggaagacctcacgaacatgtaaagtctgagcggagtcctagaagataagataaagcaaccatgagaagattttctctgagagcatgagaaacaggctgcagagaacatcaagtacctgccttcttcagacatctgtttccccacaaatagccatctattttacctgcagagaattttgcagttattctccttccctccccctctgcctttccctctccctctt

SEQ ID NO: 259523 - DNA, 681 bp, Homo sapiens
atttgaaattttcctgatggagatcatcattacaaaccttaggtatcactttacagcatgtggtaagcctgcctggaaccacagtgtacctcaacatgtaatattgattcaatgacccattgatagattgaagcctatagtgtcttatggtccctttaatgacctttaaaatatgtgatatagtagtatttttatagtttgtcaaattttgagcccattatgtcaacattctacctaaatagaaggatgagctaatcatacataaatttattctagatgaaacaacgtttttttttttttgactcagctgtgacttttggaaaagaaactagaattctagagaagttattattatacatttttttcctataaaatttatcctaacatatcaggcaatattttaaggtctaatcaatttatatatttagttgtaatttcacaattacaaaacaattgaaagcaaaaatatgaaaatcatcagtttgaattgatttgaagctatagtttcctatgtctatgagtggaacaaaaaaagtaacaaatattacttttatgtgttctactgccaaatcagatcctttgaaaggcacccacttagtaacttggaaatgaaacatttatacattcatccctgctaaattgctgcaaaatgtgatggttgggaaatatatattaaagagt

SEQ ID NO: 259524 - DNA, 163 bp, Homo sapiens
ttttttttgttaaacccagggaaaatgtgccaacttcattatttaagaagcttttaagggctatatattttaattatgctgaagaatgaataccttcatactattgactgctctttcaaaagccaagctaaaaaatgaaaactcacggatctcatttaatggc

SEQ ID NO: 259525 - DNA, 289 bp, Homo sapiens
tgatcccattctgccacccttgaaaagactatctggttatctaaacaagttgactctagaaagaccataggcatattttccctgaattgtataagaaggttttcaatagtgtactatacaaggggtaacctatcaagtgattattaaacttggaaagcgaacacagaccttggcccattaagtacagccccatgggctgcatcagacagaaggagccagccaaatgccactgagcaatccatttgaggaacaatttgattctctcatggattaatgaggtagggaaaaa

SEQ ID NO: 259526 - DNA, 275 bp, Homo sapiens
gccaggcatggtagcttacacctgtaattccagcacttagggaggccaaggcgggaggatcacttgagcccaggagttcaagaacagcctcatgagcaaagggaaactctctgcaaaaatagaaaaaattaacctgacaaggtggtgcatgcctgtagtccaagctactcaggaggctgagctgggaggattgcttctgcccaggaggtcaagactgcagtaagccgtgattgcaccacaacagtccagcctgggtgtcagcaaaatcttgtctc

SEQ ID NO: 259527 - DNA, 647 bp, Homo sapiens
taaaatggagtttctccaagttttatcctgtgattgatacttaagaaatttcaaaactcttcaacagcatccctgggtcaaattccaccccagagaatgtgtgcatgtatgttacatgtggcagtggcctatgtgtgtgagtgtatatgtgtgtgtgtgtgtgcgcgcgcccctacatccccaggctcattccacccactctcactgctccctcctcccactctcccctatagcgattcacttctcacatcactgctctctcttatcctccccactgccataccactgccgcttccaccttactatgccttccccccatccccttctcccctacgtgcctccttcccatcctctccccccctgcttcccctcttctcctctgctccatatgcactgcactcgccaagctgctcacctactcacggcactattactcctcctcttcctctctcaccctcacccatcctccccctgctccgcctcgtccctcctcctctgcacttcttactcactctccctacccctccctccactacgcttctcgcgctcctacctcccctcactcgcccctatctctcgctctctcactcctcttcccactcactcctctactcttcgtctcctacatcacctccccgctcctctcc

SEQ ID NO: 259528 - DNA, 412 bp, Homo sapiens
gcccagaagtcgcggttttcaccctgagaggttggagcgctagaaagcgagccgaaaggtttctctaatgttagtaatgtacgaaataataaaataattaccagtatttgagatctcgacttcatcgcggggccatgaactttctaatcagtttggaaatatttaccgaggaagcagcttcctcggagttccccccctccccccactctatcttttccacaccttactggacttcatccaggtcattaacatgtaaaccaaaccaacttcccaaatgcattaggctaccctagccgatagctgatgacttcacttatcctgaagagtttcagctgcacaggaagcagaaatagagactgataagggaggatacttatgttaaggttaaagcatgataaacacttttccttac

SEQ ID NO: 259529 - DNA, 497 bp, Homo sapiens
aggggttaggacttcaatgtgtcttctgaagggacacagttcaacacataataattattctggatgattttattaagaggtatctatgagcctccataaaataagcccatgtggttgctgggaagcagactgggttcatgaagagtatgtcatgtgatatctgctttaacatatcacactgacactgtaaatgtaactcctccctatcttcactagccttcaaagtctcatataagaatcaaagaaatataaacaaaaggagtaaaaatctatactagcctttgaaattcgggaaggattttatgcattccagtagacacaagagtggattgaaataactgatcagttgaggtgtcaacaaaggaaaagctcattaggagaaaaaatcaaaaggatctcactctaattctgtggaacaccaaaatactgctaagttcagagcaacggctcagagcaacagcaaagatgtaggacatccattgtagaacacatctcca

SEQ ID NO: 259530 - DNA, 455 bp, Homo sapiens
gcagatcatttgagagttggatgaatccattccttatacaccaaatttatgtaagttccagagttaagcaataattcataattattactaacaataattgtattaagaataacctgctgctttaaaaatgagatttaaggtcaatttaccttactcttggtgcttgtatttaataagtggtgactacaatgaagtcggcctctacaaaatcgttgggatttaaccagtccatcagaatggctgacttttatgcctagcaaattgtgttattttaaaatagtctgatacaacatattgatacaattttactttatgtacaaagttttatatgatttaaattcttcactgacaccacattcctaaaataattataatgctccctataatttcaaagaagcctggctgtgtaaatggtaaactatgtgtacactgatgccatggttaaaatcatttta

SEQ ID NO: 259531 - DNA, 310 bp, Homo sapiens
ttgaagtagctctgtggacttacaccagagagatgaaaagctgaaatccagctgccgttcattcctgctttgagattaggaaaggtagagctgaatttgggctatgttactcagaagcttttccccagctgatggaggcctgccctggaggtgctcagctccatctctgctgtccaggctgtgagcaagaacacctaaggaaagccagcagcctccttcactctccctccccatccattcaggtacaggccacaagtctgcagcatctcactacaaaatcagcacagaggcagtgatcacaccacgatga

SEQ ID NO: 259532 - DNA, 1016 bp, Homo sapiens
ggatgcgaaacgccgcgcttgccggagatagcattgagggcccttccgcggcccggcgtttcgtctcttgggacgattttgtgcgttccctcggtccccgtggggcccatagtcctcacttctgccaccccagagtcgtcgcgcttcactagacccgctccctccactgtcccggaggcccacagacattcccgcattctgaggctcgctcccgtcccgtgccgctgttaccggcctccggccccggctcatacaagcaggagcacatcgctcttttatgaaagcccttcaacatttaacgtttaaatgcgagggccgacctgtgacagacctggttgggagtgcacgtcgactaggatcttcctcgcctcgggcttcctatggagaggccgccgctggtctgagatttgggtccattaaagtaaatccagtcaacgcgagtgtgtcattccccagctatgcctgtctgcctggaatgcaagcctcgcggtggacagtgggctgatgtttttgccgtggaagcgcacggacgggagaaggagtgataatgatgtcaactaataacaggctaactgaaaatgatatttattgggaataaggcgttggcgaatatgcggtgccatagtaaaacgatttgcgcatcagaaagtaatggttttaaagaaaaatgaagaggaagataatggtttggaaataattaaccttggctacaaagaacagtagcaagtgtactcccggccgggcgcggtggctcacgcctgtaatcccagcactttgggaggccgaggcgggcggatcacgaggtcgggagatccagaccgtcctgcctaacccggtgaaaccccgtctctactaaaaatacaaaaaattagccgggcgtggtggcgggcgcctgtagtcccagctactcgggaggctgaggcaggagaatggcgtgaacccgggaggcggagcttgtagtgagccgagatcgcgccactgccctccagcctgggccacagagccagactccgtct

SEQ ID NO: 259533 - DNA, 424 bp, Homo sapiens
agtgcggaagcttgggatcttctgagcggggagaaaatggacggtggggaacagtagacaaagttagctgttctactcaaagaagtacctttaaaaagtcagagtaatgaggtaccagaaggaaatggattaaaaagttaagattatcactccagcctttgtcgctagagtcactttcaggacaggacacaagactgggttttcctggaagctgtccttacagagccccgtctttccccattgctgatcaaattgttaaattatcttttcattagtgtctccactactagaagatttcatcgttttactaaaaatctcctgcctaagccttcccagtagctgggactacagggacaagccaccgtgcctttactcagttttatgaccaccaacctttaacatacgcacaagtttgtagattgga

SEQ ID NO: 259534 - DNA, 393 bp, Homo sapiens
tactggttaacagaaaaaatttgggcagcatttcatagaagacaactgcaactctgaacatctatccaatcagttcaataataatttccaaatgtacttaatggcctattaaatcagtaattagaaatcaaattttgctaggctgcaaaagatgtcagaattatgtatgctcagactaagatattttaaaattaaaattgtatttaattagcattcctcggagaaatatattttaaaattaaaattttatttaattagtgttcccataatctatattaaaaatttatttgtatcctgctgacttacaaaaatatatgcagggcagggtaaagatacaaaaagagcttgtggtggttaaaaaaattcaatgacataaaacagttaacaaccaca

SEQ ID NO: 259535 - DNA, 741 bp, Homo sapiens
ttaggggcctctcttttagatttagagattaagacatccaaaaaaagtggatactcagaacattccacacatagaaaagtaaaaccttttaaagttgaaagaaacaacagttgtagtgttttttgttttgttttgtttattaatgtgggagagtgatttaatggtctgtatggtcttttggacattctaaaaatcctgctaaaatgggagtaagagttctaagttaagcaaaaaggacaactttttgctcatgcatgctttaatacaaattgggatatactgataaagggaattaaaaaatattttaaagtggtgaacacatctggtaacgtttatttttaatttttgtctgaaggtagaggggatgtgaattagataataggtcctttcctattctgtgaggtacaatcgtctctctgggtgataaagtacatatcctattaatattatacttaggattttgttcctcttcttcccttccaaattcatttttccattttgtaaataataaagatttctgtttacccatttgctccttttctcctccgtcttcccttcaatggaagctgacattttactgatggtttaccagtctaggtatcctgctgagaagtagattgagatttaagaaaagcaacttaccattggaatgaatgagatttactgaggaattctaattttttaaagtgcttaatttgacagtggtttacctactgttcagctgactcaaagtgaattatt

SEQ ID NO: 259536 - DNA, 434 bp, Homo sapiens
caagtgtttgctaaggcataacacatgtgacttttgctgtagttccaaataagtttctcatttccatctgagacttcatcagcctgtccttcactgtccatatcactattagcattttggtcacagccatttaaccagtctctaagaggttccaaactttccttcatcttcctctcttcttgtgagcctttcaagatcttccaacttctgcctgtaacccagttgcaaagttgcttccacattttcagatatctttatagaaatatctttctccctggtaccaagtttctgtattaggccattcttgcactcctgtaaaaaaatacctggggccaggcatggtggctataatcccagcactttgaggggccaaggcaggtggatcacctgaggtcaggagtttgagacaagcctggccagcatggagaaaccct

SEQ ID NO: 259537 - DNA, 409 bp, Homo sapiens
gaagtaatgtcaatctgtccctatcctacagacctcagtaggtgcttagtgagtttgggagatttagaaaagcactgctggattaagggcaagcagagcattttcttggatgttcctcatgggtgaggaaaaggatactggattcttattatgcaagctggccatagcccctaggagtcctagaaggcttcaggaaaggacataggaccagactggaccactctgttctctctgggagaactcaacatcttgcactcaggacttaagccatgtaggaaagacacacaagaataggcctctggatcagaggtacccggtggcccagaatggtcaggggcaagagagggaccaaattcatacagctcctggtgggctttcttcagataaaaagtaaaaggcagagtgctga

SEQ ID NO: 259538 - DNA, 1551 bp, Homo sapiens
  misc_feature (1068)..(1068): n is a, c, g, or t
aaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacanccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgattt

SEQ ID NO: 259539 - DNA, 763 bp, Homo sapiens
ggctgtacgccccggatgttacgggaccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggtaagtaaaccgcgtttacttaacgcggaccggccaaggcgtcccgcggaagccgggatgggtgggcgccccccttcccgtgctcagaccggcgttgctgaggtctaaggagggtgggcacagagccgccagcagcgggagccttccggagggaggcaggatcccagagggaggcggaggtgtgccagctccagccagtggccccggccgggagcaggggtgagccaggtgggagcgccctcaagaggggtctggggtctggaggtggaggacggctgttccaggtcctgctgggcgggtcgtgagcccttggccatcgcccagccccctcctgcccagttgagggcccccctgcaccaccgtctggcctgctgcctgcctctgacctgcacctggggatgagggttcagctgacacggctggtctggagaggaagctggcagggaagtcaccccagagcttcttcctccagggcctgtgggttgggaagggaggctctgtccggaggcccagtgtggctggtggtggggacagcagcgcccag

SEQ ID NO: 259540 - DNA, 1093 bp, Homo sapiens
ggctgtacgccccggatgttacgggaccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtg

SEQ ID NO: 259541 - DNA, 890 bp, Homo sapiens
ggctgtacgccccggatgttacgggaccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagaagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtg

SEQ ID NO: 259542 - DNA, 1072 bp, Homo sapiens
ggctgtacgccccggatgttacgggaccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggaagacccagctgctgctggaggtgccgccgtcgaccgaagacgccagaagctgccagttccccgaggaagagcggggcgagcgatcggcagaggagaaggggcggctgggagacctgtgggtgtgagcctggccgtcctccggggccaccgaccgcagccagcccctccccaggagctccccaggccgcaggggctctgcgttctgctctgggccgggccctgctcccctggcagcagaagtgggtgcaggaaggtggcagtgaccagcgccctggaccatgcagttcggcggccgcggctgggccctgcaggagggagagagagacacagtcatggcccccttcctcccttgctggccctgatggggtggggtcttaggacgggaggctgtgtccgtgggtgtgcagtgcccagcacgggacccggctgcaggggaccttcaataaacacttgtccagtg

SEQ ID NO: 259543 - DNA, 371 bp, Homo sapiens
gtgtctacaccccctcctcacacgcacttcacctgggtcgggattctcaggtcatgaacggtcccagccacctccgggcagggcgggtgaggacggggacggggcgtgtccaactggctgtgggctcttgaaacccgagcatggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggtaagtaaaccgcgtttacttaacgcggaccggccaaggcgtcc

SEQ ID NO: 259544 - DNA, 231 bp, Homo sapiens
ccttgactcaaaccaccaaatggctgaataattcaagcttgagttttttgaagaattttgaatcccaaaataagactcctaaggaaatagatatgatgtttctttcttcctccccttttaagcctaattagggtttgtacttaggtaatggagggtcagattcaggggaaagtcttgctagtatgagcttaaactatacaccagaatttctctatacccataagcttcatt

SEQ ID NO: 259545 - DNA, 1015 bp, Homo sapiens
cctcaagctcggttcagagtagccttgcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctctcattaaagattaggaataataccctggaaggtggtgtctgttagaacatactctgtgcgtggaatcaaggtagctccagtgtaagggcactagatggggaactgggagagaactgagactttgcttcattctttcagtgacagtaaagactttatcttctttgtctttggtttgtccatgtgtcaaataagatgctagaccactacaggatctcaaaaatccgttccatgctgtgattctcttttaagctgacactagactatacgattcttgcaggcaaagcacctattgatttgcctgttttccaacacttggtgccatgttccatcaacaggggcatttggtaaatgttagctgaataattaagtgttgatctttgtaagaaagaagacagaaaaaaaagaaaagta

SEQ ID NO: 259546 - DNA, 1170 bp, Homo sapiens
cctcaagctcggttcagagtagccttgcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatgggaaattcaatctgggagagtcaaactggggaccaattcagaactttcctcttttggaatgaaggagagaagagctctgtgttctccggattcttaacattctggtcatatattattattctcaatacagttgtacccatttccttatatgtgaggtaagatgaga

SEQ ID NO: 259547 - DNA, 575 bp, Homo sapiens
agctgagttcctgacgtaattcatatgattaatggtaagaagaggtttgcatacttgcttttcaaatgactatttcttggagttagatgcgtaattagatcatgttgatatgactaattttgagttcaagttaaccttaaccacacttctatcttatttcagatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgaggtaagatgagagtttatattttaatgaaataatttcatcaaaacctttgtttccaatattatttgttttaaagtttcagcagtgcaatagatgtcttgctcttaactgcttatgatctgcaacatctgttacaaatgggacagcttagctgtttaatctgttaacttttatgttttcaaattacaataaatgcggttaattttcttcttgatttga

SEQ ID NO: 259548 - DNA, 413 bp, Homo sapiens
gctgattctgattgccatctagcagcttccggtggtggtaagtggtcaagagtgtttttccaggagttgatctcaggtttttgagaatgccccctagagacccagtttgttttctgtatcatccctcaagctcggttcagagtagccttgcttttctccttggcatggtcacggaatggatacctgtttgatcttcctgcactgctgagaaatcttccttttgggggagaggattaagtctgggttgaggtgagtagatgggtagcattcaatggttagtgagatgaagtggaaatttagctgtgggctggttggaacgatctgtttcttttctccagatccctattttgttttgctgttttcatcttggtgactaaggtttcacaaatattctttattattccccttttgct

SEQ ID NO: 259549 - DNA, 392 bp, Homo sapiens
tttttttttgcttatttcaattattttagccagtaattgtattttacttagaagaaaataagccaataatatttaaataacaaaaaggtgaattctatatatatatgggttatactaaaattttttgtgttttaatcatagcatattcttaaataaggcagggaaaatcaataaaatggaaatttatgtagtcaaggataaacaaataaatcataaatatttaatctaaccttcaattttgcatgtgttaaagtacagatgaagggaaataagaattaggaaattcctaaaggtatgcagagatgatgatgtagatgcctatttttgaaagctaaataaaacttactagttatcttaattttaaaacagttgctaatacttcctggattatc

SEQ ID NO: 259550 - DNA, 105 bp, Homo sapiens
cattacccacataaacagcacacacaccaaaaagcatcagcagcccctcatgcacccctccatagccgctctcacccccaaaagtaacccctcttgacttctatc

SEQ ID NO: 259551 - DNA, 240 bp, Homo sapiens
ataagccattgtgctggccaggtggtcccttttctgttctactctctcccaccctcatgcctccaggatgagcttctggccttctagaaggaatgaactggaggaggcccaaaatggcctctcctgaggctgatttgaaggaatgtggggtgtttttcttggagtggggaaaacttaggtatgcggtggttatctccagataccttttgttccctaaagcttttttaaaaaaatgattat

SEQ ID NO: 259552 - DNA, 735 bp, Homo sapiens
ctgcattctttgaacagtagtctccagaggttccagtagataacctcaaggagcacagcaccagggagtaattgccctcagcaaacctcctggtggcaggtgcagaagcgagtttgcccacattttgcaatcatgataaacagttggctgtttgatcatatagccttcagtggaatgctgagttggtcacgaccctcaggcctttggctccctacattaaaacacccatttcaccagattaaaaatattcaataaaatttctaaaaagcacttaacacttgccagcacttactaaggaagtgctcaataaatgctgttaacactcttactattatttctctgcttggcagttgtcctaatcccacaccagcccttccacatagcctaatcctgacttgtgtcagtgatgcatgactcaacagtgaatctgggacagctattgcaaaatgcaagacttaaaatccatcccagatgaattctcttctggaccgcaggcagcccttgaaaaggatgagagtagagccctcaatcatggaggcatttgtccctcaagataggcagatgttaccacctccatacaagaacaatcccattgcctattacagttcccatttcagagagatactcccacatatgtatgtatttccctgaaaggtttcttgttcctcttctttttttatttttttgagatggagtcgctccagcctgatgacagagcaagatgccatctcaaaa

SEQ ID NO: 259553 - DNA, 449 bp, Homo sapiens
ataatggtgagaaaatgagaaaaatgcatgcaagcttagcatattattagagtgataaatgctaacaattataaatcatgtcagggcctctacattattttagcatttactttcctctgactatctgtacattactggataaaaatattttattgatcaccagatattaaactcctgtgaatttctgtgtgttgatggtgaagttggtgggaggatggtgatgagacttacttgaagacaggaatgtatgtgagttgaccatgtcagtaagctgagatactgtcaatttctgaaggattcctctggctgagtctacacagttaagaagtattatatatttcttgatgtctttcctaatgtctaactgaaattctctaattgtctcatgttttattcctcatttatggagatgctggacagcattaaaaaatattgaaacgtgaatactt

SEQ ID NO: 259554 - DNA, 411 bp, Homo sapiens
ttattaaggtctcccatgtgtctggtttggttttcagtctgtttttctatgcatgttttttcatagtgtgactgtagcctttgttagatttgtggccttttccctcaccaaactgatgaatttttttcatgttgcatatttttcattactttctttgacttgttgcaaaaacactttggataattataccccaatttccctatttattcccctaatagtggacattaaggtcatttcctgtgttttgttatatgtatgttatgaatattttatgtatagatgtctgcaaatttttctcctttttagcattacaaatctttattttaaaatgattagacacatgctactgtagaaacttgaaattctatataagtatataaaataaagagttaaagttctctcattatcgtc

SEQ ID NO: 259555 - DNA, 400 bp, Homo sapiens
aatattatgtaaatatgtggatatgttttagaactaggatgttggggttatgttccaaagaattgctacattctggggagtgtcaaaagcgagggatcaaccaactcaacaaatagtggccaggagcagtggctcatgcctgtaatcccagcactttgggaggccaaggctggtgtatcacttgaggtcaggagtttgagaccagcctggccagcatgggggaaactctgtctctactaacaatacaaaaattagccgggcatggtggtgcacgcctgtaatcccagctactggggaggctgaggcacgagaatcgcgtgaacctgggaggtagaggttgcagtgagcaccactgcactccaacctgggtgatagagtgagactttgtctcaaaaaaaaa

SEQ ID NO: 259556 - DNA, 2064 bp, Homo sapiens
  misc_feature (971)..(971): n is a, c, g, or t
aggaggcgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgatggaaaaatccaaaaatttccgcatcgacgccctgctggcggtggaccccccacgagccgcctctgcgcagagcgcgccgctggccttggtcacgtcgctcgccgccgccgcatctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggcacgggcggcgggcacggggggccccaccaccacgcgcatccgggcgcagcggccgctgccgccgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacccgcaggtgcaaggcgcgcaccccgcgcaccccgccgaccccatcaagctgggcgccggcaccttccagctggaccagtggctgcgcgcgtccaccgcgggcatgatcctgcctaagatgcccgacttcaactcccaggcgcagtcgaacctcctggggaagtgccgccggccgcgcaccgccttcaccagccagcagctgctggagctggagcaccagttcaagntcaacaagtacctgtcgcggcccaagcgcttcgaggtggccacctcgctcatgctcaccgagacccaggtgaagatttggttccagaaccggcggatgaaatggaaacgcagcaaaaaggccaaagagcaggcggcgcaggaagcggagaaacagaagggcggcggcgggggcgcggggaagggcggcgcggaggagccgggagccgaggagctgctggggccgccagcgcccggagacaagggcagcggacgccgcctgcgggacttgagggacagtgaccccgaggaggacgaggacgaggacgacgaggaccatttcccctacagcaacggcgccagcgtccacgccgcctcctccgactgctcctcggaggacgactcgccgcccccgcggcccagccaccagcccgcgccccagtaggagccccgcggcccagcaggtgcggcgcgcacggagcgccccggccggcggcttctcccggaggccccggcgcccgcacccacccggcccggccccgagagcaggctcgaccgccgccccatggacccctcgcccaggccggggctggagggattcggccgcggcctccggtcctgggcgcttcccttttaagcaagggcgcctcacctgctcttcaagaaacagcgagagggagacccagggggctgaaacttgaactctggttcttttaaaattaattttggttggtgttgggggaggcgcgagtgcgtgtgagaagaaccgacccaccccgcgcaaggggaagcctcctgtctcccctttccccgcgtccgagaaggcggaaacccacagtgttacctgacttatgaaacttgaaaccgcctctggagccgccattctgcagagtatttggaaaaagaaaaaagggtttatgcttacgtctctggggtcggggggattatgtcacgagcgttcaaactgctggaaatctcaaaactgtactgtctttatttttgtatattgtatttatatataaaaagaaacgtctacgtatgcatgctaaattattatttagcttctcccatcgcccacgatggaatgtaaaataaattggttttgtactggaaaag

SEQ ID NO: 259557 - DNA, 348 bp, Homo sapiens
gagctgacccagaccctgagcagtgccccgagtggagccacccttccaagggaatcagcaagtatggctgagaccatgtcagcgtgactgccaatgacacctcattgatgatgacctctccctcccttccaggccacttctcttgggtatagaaacaactcttttgaacattcagcattcctacccctgtatgtgcttggatcaaaaacaaagatttaaatggaatttttagtctgtaaagtgttttatcctcatttttgctagtttgttatcaaggagtctcagagttgtattaagtgtatattgcatgactgattgaaaaaaaataaagaaaattcagtcaccaga

SEQ ID NO: 259558 - DNA, 557 bp, Homo sapiens
ctcagtccacaggaagtagaggtgagattttagctggcacatagcagaatcaacaatggtaagagaaaatgcaaagcagtggtatatattacatttcatgacttgaatataaatttaaactgttgttaggctatggtctctgtccctttgtgtacttcccatgagcactcatcagaactgcttttcattcagttaggtcttctgtgactagttgggtaatactgaggcatcagtttggtggaagctactgatactgtacttcctcatttagcccagttggttctcagagtttataagtccattggccccttaaggaagtcaatgaaagccatagattctgtctaggaaaaattgtatatacttgaccatgggacctgggattaaatatctctgccctgtcccaacaatatcggcttatcttaaccactctcaaaagtgttggagataaatggcagaaagctactttttatacctcagtagaaaaaaaaaaatgagcaagaacagatatttcacaagagaagatcaatgaccaagcctataaaaaactggtcagcctt

SEQ ID NO: 259559 - DNA, 415 bp, Homo sapiens
gaacttcaatacgccggatagaacaaatgacagaaggttactaaacagaggacttgaacaattcaatagaccagttgaacctaacagacataaagaacactccagtggctgggtgcgatggctcacgcctataatcccagcagtttgggaggatgaggcaggcagatcgcttgaggtcaggagttcaagaccagcctcgccaaaatggtgaaaccccgtctctactaggggtattgtactgtattttgtattgtaaaaataacaaaaaaaaattagctgggcatggtggcacatgtctgtagtcccatctccttgggaggctgagtcacaagaattgctggagcttgggaggtggagctaacagtgagccaagatcgtgccactgcactccagcctgggtgacacagtgagactc

SEQ ID NO: 259560 - DNA, 1832 bp, Homo sapiens
agtttccacaacgtgaccccagtccctaccctcaggtccccatgccagtgggggatacagacaataagcaaaagaagtgcatcctgtcacatcacgttagaaggtggtaggtgcagccgggtgcagtggctcacgcctgtaatcccagcactttgggaggccaaggcgggtggatcatgaggtcaggagttcaagaccagcctggccaagatggtgaatccccatctctactaaaattacaaaaattagcccggcatagtggcaggcgcctgtaatcccagctactcgggaggctgaggcaggagaatcgcttgaaccggggggcagaggttgcagtgagccgagatctgcactccagcctgggcaacagagcgagaatccgtctcaaaaaaaaaacaaaaaaaaaaaaaacaagaagaaggtggtaggtgccgtagagaaaaatgaagcaggctgaaagcagtgaggcatgtccacagattacaaaaggcacgtccaggaagtgggcgtgtaggcagtgagctgaaggcaaggtcattattaaagtcttattatgaggcagccactgaagggtttcaagttcatggttctaattgttttacattttaaggacaaacccaacatacgggccacttttcacacgagtccaaatcaaaagctattttattataacagaaaaaaactccccctttgatatagtcagtcagatacaagccaatgcacacatgttctcaagataaatgataacttgtctgcaagtaggaggacctggcaacaccgcttaccacagcagttctaaattccgtgggaattgggatggccatctgtgtgagccaactgtctttaaccaaaggaaaaatcaagcatgtgatacgtctagggcatacaacttggagccacgcagctaagctaaactcccatgagacagggatctccacggcagtgctctctcttttatgtttacatttcaaacaagtggcccttaaggaaaacattattgggttgtaaagaaagaactgatatattttctaaggaaaatgaactaagagaggggaagaggaaagtctctctttttgcaccaggaaaaacccaatattttctttttagcttttaatataaatcttaatttatattattgatatttattatgaaacaagtttatataaaaatttttagatgggtaaatgtttgcatgcgcggacccctctacagagggcgtgactcacatggatacctttgggaaggcattctggtggcgggaagggcaaagccaggggcctgagagggaaactgccggctgctggcagaacagcgaggaggccagagggtcgagggggagggtcacaggtcagagagacagtccgccctgagcccttgcccttgaccccaggccattgcttcagacaccatctgttgtgaggaccaatccattgtgacccagtgtttttgtaccatacaataaaaatgcactgctagaaaaacaaaattaaaaaccacagtccactgatgtcacttataagccagacacacagaacaaatgccgtctgattccacggatgtgggattacctagaggagtcaagtccacagggatggagagtatacggagggcgccaggggcttgggcgtgggaagaggaattactgtttaataagtacagagtttcagttttgaaagatgaagaaacttctggagatgggcgggggtgatggttgcacacgacatggtgaatgcacttaatgcccctgaactgtacacttaaaaatggttaagatgggaaaggttgttacgtatattttactacaataaaaagaacattttttaaaaatctga

SEQ ID NO: 259561 - DNA, 245 bp, Homo sapiens
gctactgtaagttatggcttggaagtactgctattagacacagcttttgttttcccaagctatgtcatcttgctttataacatttacataatgccatgaactatgtgtaatccataccctattcttctttcacatctttcgggtgtctgatgtatgtctccaaataatattttcatgaagaatacatgaatgctctatttcctgagcctttgaatatatgggattgttcatttgttgtcttcaca

SEQ ID NO: 259562 - DNA, 493 bp, Homo sapiens
gcccactcttgagacttgtagcatccccagttcaccctctcatttgtcactaggaaaactcctgtcagctggcattcatatttcaacttaaaagaagcagtcgataatcaatgcctacacctgagatcaagtaacatttagaagcactggagggaagcaaacaacatatattgtcaatgaagaaccagacatgaagctggatattttacttgccttatctcattcaatccataagacgaatattatggcctcccattttacatctgaagaaactggaggtcagaaaaaggctaagtccagagctggctttttgttgttattgtcagtttgtaacaaacaccatcctgcttagtatgcaccctacactgctctaagcaccttaataggaatgcatttaatcattgtaaaaatcctgggattctattgcaggcttaggtgactcaaaagccactctttccacgacaaccctattaaaacaagaaatgtgaataag

SEQ ID NO: 259563 - DNA, 455 bp, Homo sapiens
gaagtggtaacaagaaggcatggtttttcttttcttttttaatatttaggagaaaggatatttgaatatgtttacatatacaattgaattcagctgtctttcctggaattgctactatgttccatgcaatttgttaatgcatagcctacttacttacttaggcaatagagacctttgaagatcaaagtagaaagggactgattaatgaagcaagaatcaagggcaggcagacagtggaggggagggtgatgggactcagagtaagaacatagcaataaggaagaagtcagagaaatttagaaatgaagaaggctgctattctcctcctggatcttttagcaggctggaggcaaagttaactgatgaatgtccaagaagtggggattaggagctggaggagaatggaagtcattggaaaaattgctgttgggaacacagtaggcaaagcaaaaaaa

SEQ ID NO: 259564 - DNA, 419 bp, Homo sapiens
gtattcgatattaattttatcttcgttctttccttttgattgaggaattctttatctctcattgttccatcttttgaaaactgttttcaaatttctatttgttagtcttcattttgatctacctctttgcttccttctggctccctgtgataagtatgccagtaaggtatatttattcattgtggagaatttatttaatgatagctaccacttttatatgctttcaataaatgttccaggcactgtgctcaacattttacatgcattgtttctctatgtcttctttagacaataagttctttaatgtaaagaacttctcagtacctgtcatactttgcagtcaataaataactacatgaatgaaactactgattccatatagagacagggaagtttatagctgtaaatgcctacattta

SEQ ID NO: 259565 - DNA, 507 bp, Homo sapiens
atacctgggaggaggggggtgcactcacgttggaacactagccaccaaggtatgaccagtgctacatcccatcctccctcacaataggctaaaaaaatagatgtgacatacatctaaaaggacattgcctctgtaaagatgagtgacaaatcaagaatggatgaactttaaagaaggctaacatgaaagagagacaagaaactcaatagacgataaaacttccatctgagaaaatgaattaacacagcaagaagattaggtcttttcaataagtatgacttgtatcattaaagaaatgtgaaagggtaatatacatatgtataagaataaattagatattgtggaaatttgaatgattgttgaaataatttaatagaagggggttgggtgtgatggctcatgcccgtaatcccaaaactttgggaggccaaggaaggatagcttgaggctaggagtttgagaccagcctgggcaacatggcgagactacgtcactacaaaaaaataa

SEQ ID NO: 259566 - DNA, 516 bp, Homo sapiens
gagttttccttccctcttatttggtcctcaacatgggttttgcatcaatggagtagcatgtcctacttaacaaaatgccagaaagtaagtgccttggtgaggctttaagcagcttccagcagcattgccacaatatgtcccataatgatcaaccctgatgaattttgagaatatgcatagtaaagacatttagactgggcttgagcaagaaagaatttgtcaagtcattgaaaataagtaagaatgactgttctataagctataaatgtactttttacaaattattggctataacatatgtggaatataaatatttggaaaatatcatatgggcatcacatatttttttttatcagactcttgatttttttttttaaagagatagagtctcactctgtcacccaggctggcatgagattatgccattgtagctcattgcagcctcaaactcctgggcccaagtgatcctcctgtctcagcctcctaagtatctgaactacaaccatgtaccagtat

SEQ ID NO: 259567 - DNA, 351 bp, Homo sapiens
atgcttgatgaatctctaaattaagaatttaatagtaaatcttttgttgttgatttaaccatgttactatgacatcaagtctgtagaattattggatagacacaaagttacctaaaatacctcagctctttctcctcttgccatattattggttattaatgaatattagggtgagtcttctaacagtgggagtgataaatacctcagctctttctcctcttgccatattattggttgttaatgaatattagggttagtcttctaggagagggagtgataatgtagttggaagtcattctcaagagagtcttccctcaaatcggaagtgaaaatctcattaaacatcaagcg

SEQ ID NO: 259568 - DNA, 1246 bp, Homo sapiens
  misc_feature (6)..(6): n is a, c, g, or t
  misc_feature (12)..(12): n is a, c, g, or t
gaggcngtgcgnttacgggttgcgagaagacgacagaagggacacagtgtagacagaatcaggccctaagcaagtgctcactggtaatattcagacatcagagcaaattagaattttggataggggttaaaaaatcgaggcatataactcagataaccgaatgcttcaaatctccaccatgtcacacaagaccaggctacaactgcatatgatttgacgtggtttgttaactgctctctaacatcaacagaagaactcagcaaggaattgggaaacagaaatgcttatttagagacaaggagtggtcagcatccattaatagtttccaaagattgagatggtgaagtaaccaccccctccatttagagtttctcaccagcatcgttccttacttttgctgtgggccatactttttatatttgtatattttcctacagcccatgaggttttagtccctttttcaactgttttgaggttgattaggcagatctcttttttgtaacagaaactgtactgcttttattcgattgcaaaagcaacccacagcatcgtagaaaatgtagaaaatggagctgaaggaacagaagaaaacacgtcacacgttatttattcctcttaccactgctaagattttgtaaaatttccatttaattttttgattgtggctgagagcgtgagtttggagatttagacaaaattcttgctttgtgagctgtctgagttcatgcagtttacttaatctctctaaacctcagatttttaagccaaagagctgatcatgccttccttcaaagggccaagcgactaaataaaccaggagtacttcctcacagcaatactctcccatagcatcatttttaatggctctagagtactttccatcatatgaatatgacattatttatttacaatattctattactaaatatttcagtcgttttatgtattctttactattaaaatgcatagagtgacttataaataatctccagtctctccctttgtttcctatgtattatgcagcagagaaatttaattcaactaatttacatcaaatacgctgagcacaagtgtctgtggtgagaagtaagtggtaggccctgcccttacagagctgagcaggatggtaggttggaaacagcactgacctgggaaataagaaattggagtctcagctcctcctccgcaatcctcttctattaactgtaacttgggcaaaagatctaatttttcctttctcatctgt

SEQ ID NO: 259569 - DNA, 237 bp, Homo sapiens
ccccttccaaaaggtagaacacttgggtgtggttcttgacaggaacattatggctggtggtcattccaggatagtgattacgcactgaaattcctagaccattagaaggaaacaaagagtgggaatcacgttcaaacatcatgaaccactggagataaaaagtttggcctatgaggaaaaaaaatataaacgttatagatctggcctagaaatacaccaagaatgtacagttaaaga

SEQ ID NO: 259570 - DNA, 265 bp, Homo sapiens
attttgtttttatttttagtagagatgaggtttcaccatgttggccaggctggtgttgaactcctgaccttcaagtgatccgcctgccttggcctcccaaagtgctgggattacaggctatttttaattttttttaataaagaaagctttttatttagaaatcccatcctttttgataagcagcattttttttctttctctttttttttttttgagacaaggcctcactctgcagcccaggttggagtgcagtggtgcaatcttg

SEQ ID NO: 259571 - DNA, 453 bp, Homo sapiens
ttgatttttagtcaaaactaacagcaatggaggatttgaaatctctaatagacttgtaggaagatggaagttctattttattatcactcttggtttccaaatggtcagtctttcttttgttgcccacatcttccccaatacattcaaccccagtaaacaactagtaagagtttaaagaaaatgtaagatatagaaggtagaattgcaagagtgatgactttgagtagaagaaagaagatgagatctagtacccaaaaggaggcgatggtcttaggagcaaagtacatatcatctatagttaactgatggaaggcaggatcttgaggcaccggtgcaggtatgaggtgtttgggaatagatggagatcggagcctgtggaatttctcttctgatggcttctttttcttagcagatgaacaaaaagaagcggttgttcaagaaagtttgattttt

SEQ ID NO: 259572 - DNA, 471 bp, Homo sapiens
aatcatatgagcctctgctctgattccaacccagtatggctggaccataaggagacctccctgtgtgatcggatcaaagcccctatgcagtgtgtcttttcagagcagggtagagataaattaatcacacctatctaattttaagtaacatagtcaaagaaccattgggaaaaagtcacggcaggagcaacagaaagtcagcctctaaaaaggttcatgtcactaaagagacaagacgtcatgcctgacaatatatatttgcagttttctgctttgtaatttttctcatggctatttaaaattaaattagctcttttctgttttaatagcagatataaaaaggacactttggtcatgatgcatagcacgttaaatacaattatgtcaatatatctttctctgcctctttatgcagttttttttttttttcctagcctccttcagagagctctttgggagcaactttagcta

SEQ ID NO: 259573 - DNA, 701 bp, Homo sapiens
ggaggctgaggtgggtggatcatgaggtcaggagatcgagaccatcctggctaacacggtgaaaccccatctctactaaaaatacaaaaaattagccgggcgtggtggcgggcacctgtagtcccagctacttgggaggctgaggcaggagaatggtgtgaacccgggaggcggagcttgcagtgagctgagatcatgccactgcactccagcctgggtgacacagtgaagactccgtctcaaaataaaaataaaaataaaaataataaactaccatttacagtagacactctaaatatatcatttctaatatcaaaacactgttggttttattgccttttcttatgaatggggaaattaaggcttagagatgtgaattactttgcccagtgtcacacagcaagtaaatacctgaggtggggaggaaaacccatgtcaatgtgagtctcaagtctctgttctttcactatgctaggctgccataattttctaggtatgcatttgccttccttgacttttcacttgttgtaattttgggccagttaagtcagcatcattcagagatagggactccctgctgatggaatttgtcttccttaggtgtcatatccaagtaattacagagtgcagtagagctagattacaatactacacattgtcagtaggtgtcactatcttatctaatgtgattatttgttcaa

SEQ ID NO: 259574 - DNA, 1615 bp, Homo sapiens
  misc_feature (1009)..(1009): n is a, c, g, or t
  misc_feature (1211)..(1211): n is a, c, g, or t
  misc_feature (1216)..(1217): n is a, c, g, or t
ccgcctcctaggttcaagcaattctcctgcctcagcctcccaagtagctgggactacaggtgcccgccaccacacctggctaatttctgtatttttttttttagtaaagatggggttttcccatgttggacaggctggtctcaaactcctgacctcatgtaatccacccacctcagcctcccaaagtgctaggattacaggcatgagccactgtgcccagccaatataccttatttgttagccttatttttgttctgtgataagtatggttcattaataactccatatatttataacgttccaaaggacttatacatgtagttccaagtataagagctatgtataatgttaactgtgtattcaggtcaatggaatagatttggtaatctaacatgaaactcttttaaaactcttgccccttgcaatccatttatttcataattaaggacaatataatcaaatatgagcaaataagcattcaaatggacaaaaatgtactgtactagttatgttccatctgggatcttgtaatctaagatgaatgacctggtgctttattttgcttctcataatgacatgccttcagagaagtgtggataagataagaagttagaagggcaggggaagaaaccttccattgtttggatgttaatatgtgccagaaacaaacaaacatagtctatgcttttcatgtactttgtctcctgttattctttcaacaatctttttaggtgtcttttatgacttttactttgcacatgagttagttaactcagctcagagaagttaagttcatttgtctcaggttatgtaactattaagtaaaaagcttgagactgagacttcattctttcttattggtccttgctcttataaacagtaaaataagtactcatccgataaattcaaagtaattttagaacattttgaccaaacaagtgtcagtttttaaagttgtttttctattatgacagtaagtttataggccttagaaaattttaaacttctnaaaaatgattttgtcttttatagaaaagttgtaagaataatacaaagacctccagtacaagttgagtatcctttatctaagatgattgagaccagaagttttccagatttctgatttttctcagatcttggaataattgcatatatataatgtgatatcttggggatgcgaactaagtctgaacgtgaaattcatttatgtntcttnngtttttttttttttttttgagacagggtctcgttctgttgcccaggctggagtgcagcggcacagtcacggctccctgcaacctcgacctcctgggctcatacagttctcccacctcagcctcccaagtagctgggactacaggcatgcaccaccacacctggttaattttttgtagagacaggatcttgtcatgttgcccggagtggtcgcaaactcctgagctcaagtgatccacttgcttcggcctcccaaaatgctaggattacaggtgtgagccaccatgcccggtctcatttatgtttcatatataccttatacacatagcctagcattaattttatacaatgtttttaataattttgtgcaagaaacaaaggtttgaatgcattttaactc

SEQ ID NO: 259575 - DNA, 227 bp, Homo sapiens
tttcacaccttaagaaagcactccaacccccaagggcatcaacttcaacaggaaaactgacccttcaacttaccaaatctttgaagtgactagttgtatagtacaacaagcagaaaatttgctatggaggttgtgttaactgttgacatttatgtgagatttttgctgcatatttgttagaaaaggctcaacaaaattataataaacaatgattgtgttattaattt

SEQ ID NO: 259576 - DNA, 479 bp, Homo sapiens
agcgcacagcccgaggactgcgaggacggggaggacgcgccgcggccgggcagggaggtgaccggcacccagacaggtggcgacggcagaggagcgcagtggttcacacctgtaatcccagcactttggcaggtcgaggcttgcggatcacctaaggtcaggagttcgagaccagcctggccaacatggcggaactgtctctactaaaaatacagaaattagccaggtgtgatggcacacacctgtaatcccagctgcttgggaggctgaggcaggagaatcatttgaacctgggagacagagcttgcagtcagccgagatcgcaccactgcacgtcagccagcctgggtgacagagcgagactttcaaaaataaataaataaataaaatagaattctgaactttatttttaataattattttgtaaaaagaatgtcttgttttttggagttgttgaatttattgaattgaccaaaatt

SEQ ID NO: 259577 - DNA, 407 bp, Homo sapiens
atggcacatcatcttgattactgtagctgtataataaatcttgaaattatgtagtgttaagtcttctaactttgttgctcagaattgttttgactgttttaggttttttgcatttgcaaaccaattttagaatcagcttgtgaatttctacaaaaagggtcaactgagaatttgggattctgttgactgtagatcaatttgtgaaaacctgacataaaaatattgtaccttctaatacaagaacacagtatatctctgtttttgcaggtcttctttaatttctttttttttcttctccttttttgggacagggtcttactttgtcacccaggctagagttcagtgagccgagatcgtgccactgcactccagcctgggccacagagcaagactccgtctcaaaacat

SEQ ID NO: 259578 - DNA, 475 bp, Homo sapiens
ataagaggtaggtctctcagattcccagggtagttctatttccttttttccccccacttttgcttagcagttctgcaagtagagaccctactgccactctttcaggagaacatgaagagaaaatgtgattataatcacaaccggaacatcctgctcattgagggtatttagttaaaggatattgtgatttatcaaaacttctgtgaactcacctttctaccacctgattggtcaaaatgaatggaataagatgaagctgaattgcagtagggcaatccttttttcttggcatcttcattagccttcaacccacaactctttaatttaaccctgggataagcaaatctgtatttataccagatttttgcagcacaaaggatactgttggccctggggtgggtttgtgctatgatttccccactgtgtcttctgttttattccagataagaaaaagaataaaaatagagaaaattca

SEQ ID NO: 259579 - DNA, 488 bp, Homo sapiens
tgggaacagagtctcttctcccttcctcaccacagtgggcaagagggaggctccctaaagggggaaggggaggaattttgaaaaggaaagaagaaaagcaggagtggttggaagcagcccacatgccctcactgccgccagtaaggagccatggccacagactggtctggtctgccctgcagggataagaggggagggaatcaagtttggaatcaatctcaaaacaaataggactgagtcctagataccaagaagatcgttctagagagaaagtgactgagagtcatggagtccagaacaggagggtttagggctctctacccatcagagaagaagggttccacatagtagactcgggtggttatcccaaacatgcctggaaccccatcttagctggaaatactcaagtttcaccatcaagtatgatgctggcttcagagacggataaaaaacataacattaagttttccatctgtgtttcttaaaaa

SEQ ID NO: 259580 - DNA, 346 bp, Homo sapiens
gtagtcccagctacttgggaggccgaggcaggagaatggcttgaaccccggaggcagaggttgcttttaaaaaatttgtggggcagccagggacagtggctcacgcctgtaatgccagcactttgggaggctgaagcaggtggatcactgagcccaggaatttgaggccagcctgggcaacttagcgagacctcatctctacagaagttggcaggtgtggtgatgtgtgcctatagtcctagctacttgggttaaggcagaaggattgctcgaggctgcagtgagccgtcatcacaccactgcactgtaacctgggtggcagaacaagaccctatctatctttaaa

SEQ ID NO: 259581 - DNA, 429 bp, Homo sapiens
tttacaggacttttgttttcatctaggctttttatttccatgtttcctagattgtgcttatagattacactaaatctccaggtgaatgaaaaggactggtcatgatacttatttagaggagtagtttttcatataccacgttgaaagtgtcaggaagagaagatcccttgtcggtccaacaaagtcaaacaaatcaaaacctgttaacactagggattgggctgggaacaattcatcagagagtatcatagcactgtaggtctcaagagggcatttaatagcgcccgtggcaataacaaagagatgcagagaaattcactcaccagatcttttggcagaaaaaaataaattgatgaaggcaggttattgttgggcccatagggagaaatattcccacaggtaaggaaaagtaagcatcatactggagat

SEQ ID NO: 259582 - DNA, 498 bp, Homo sapiens
ccaccctcatgaagacttgggacccaatgcttggggggatcctgtctaggagaccctgaggaacgttccgccgccagcagcaggcatgtctcacactcccaaaccttttcagggggtgtagaaagcagtgggcttcctgcaccggatggaaggttcgcttatttgctcaattgtaactgggaccaagaagcctggtagaagatacgcactcactgttgccagcaagaaccaaagatccagaggccacgagacacaaatgtagaaggccaagccctagccccacccgatagaactgtggcccaatcagtgacagttctcactaatcaggaagcagtagtaaaagtgagggaacccgcattcctgctctttaactttctggctttggggagaggtaggcaactcttctttgcagaaatagaaaggccgaagagggggagatggcaagtgtctcccctaagagatgcaccattctccctttttataacccagacatgtgca

SEQ ID NO: 259583 - DNA, 534 bp, Homo sapiens
caccctgcacaccctccctgagggatctcatccatccccatggcgtcaaccaccacctgaggaccctctaggcctgaattgtctcctgagtgccacacccagctctccagcatcttcagtgttcctccccgggtggaatgctccacagcactgccaactcaacctgctcaccaaaacccagcttgtcatatctcctctgggccagccctggcttccaggctcctggacttggtcccccagatcaaagatccaggggtcactcatttggactgagcttgatggaaaagtgcttatgtttcaatgttaagtaaactggggagcctatcaaatgtatagacatgatgaactcattgatgttaagtacatagatggaaagagaaatgcttcagaatgtattagtggttgcctctaatggtaaaataatgattgacgttttctttttctgacacccttgtgctttccaaatctcctgcaaaaagtatttattacttttgtaaccagcaaaaatgcctaataaaaatgattgacaggtct

SEQ ID NO: 259584 - DNA, 310 bp, Homo sapiens
tttccgacattgacttgcagaggcaaaaacaaaaagacaaaacaacaacaaaaatacatcagagaataaactaataaccaaagaagaaactgaagacagtcatcccttagtaacttcaggatattggttccgggaccccagagataccaaaattcactgatgctcaaggccctgatataatatggcatagtatttgcatataacctatgcacatccttccgtatattttaaatcatctctagattactataatacctaatacaatgtaagtgctttgtaagtacctgttataaagtatttataacttttt

SEQ ID NO: 259585 - DNA, 226 bp, Homo sapiens
tttggcaaaataaaaggccaaggaaataatgaacatatgggaccacttgtttcacactttaaactcctaagcaagttcggtattgttttcatttgtgggaacataaaattctctggttctctgtgggtgtactggactgttccctacactaaaggaaaatgcactagaggttctgtcttgtcctagaactgtaagtactgagatttatctgacaatataactcagc

SEQ ID NO: 259586 - DNA, 536 bp, Homo sapiens
ccagcggtcgaattaactggttctgtctgtacgactgggagagcagctctcgctaaaaatagcgccctgcccagctcgacctgcgagccgccgttggattctgagccgggacggctcaaggaggccgggagccctgcacacccctcaccccgggcctggcccgggaccgaccacggaggcggaggccgcgggcaccgcgctggccccacaggtgccgcggagggtggcaggcccgctggccgaggcactgccgaggccgtccgagatgggagctggcggtgcctccttccgcgccctcgcctgggcctccctgcccctgctggggcctccagcctgcgcgctctgcgaggacacgctctgctgcggagagtcgcctcaagaaaggccgggctctcggcgcagcctgcctggcagcctttccgagaagagccccagcatggagccctcggccgccacgccgttccgggtcacggtaactatctctgcgtcaccaacaccgccactgccaccaccatcaccacctcgcccggggtgct

SEQ ID NO: 259587 - DNA, 384 bp, Homo sapiens
gaacgcgtgggcgcccgccgggctgtccggagcggccgatggggcccgtgtgagcgcgcccaggcccggcccggtgcccggcgggcggcagcatgtccgcgggcggcagcgccaggaagagcaccgggaggtcctcctactactaccggctgctgaggcggccccggctgcagcgacagaggagccgctcccgcagccggacccggcctgccagggagtcgcctcaagaaaggccgggctctcggcgcagcctgcctggcagcctttccgagaagagccccagcatggagccctcggccgccacgccgttccgggtcacggtaactatctctgcgtcaccaacaccgccactgccaccaccatcaccacctcgcccggggtgct

SEQ ID NO: 259588 - DNA, 517 bp, Homo sapiens
ccagcggtcgaattaactggttctgtctgtacgactgggagagcagctctcgctaaaaatagcgccctgcccagctcgacctgcgagccgccgttggattctgagccgggagccctgcacacccctcaccccgggcctggcccgggaccgaccacggaggcggaggccgcgggcaccgcgctggccccacaggtgccgcggagggtggcaggcccgctggccgaggcactgccgaggccgtccgagatgggagctggcggtgcctccttccgcgccctcgcctgggcctccctgcccctgctggggcctccagcctgcgcgctctgcgaggacacgctctgctgcggagagtcgcctcaagaaaggccgggctctcggcgcagcctgcctggcagcctttccgagaagagccccagcatggagccctcggccgccacgccgttccgggtcacggtaactatctctgcgtcaccaacaccgccactgccaccaccatcaccacctcgcccggggtgct

SEQ ID NO: 259589 - DNA, 356 bp, Homo sapiens
ggtcctcatcatggtgaaggctggtggggaggttcaaagatttgtccatgggtcaacacctccccaaggccaggtctccagggacacagactctgccctttgaaggctccaagccagaagaggaaacagaccctgaaacactatgagcaggagggccagagagcgacacactttggtatccaggagacccagccccactgcctgcaaccctgcaacctccctgtgccccactgagctgctcagtaaaatggaactaaggatggtgccaactgtcagtgatgctgagaggtacaacaaggaggtgaaatgtgagaccctgtgcattgtggacacccaataaacagtgattcttttta

SEQ ID NO: 259590 - DNA, 393 bp, Homo sapiens
ggggttggggggtccttttttctggaacaaatgccacctcctcagagattaccagaaactgctttgctgtcttcagaggtcctaaagtaccctggcctccatccatggaccgtcagggtgggtgcaccctcccctccccccagtgtcatttcattgccatgcgtgcttttctggggcagaggccataaaaactggcacacagtctgttttcaggaaattcttacagaatggattgaaacttcccatcaggcacacacttcctccagcctctgtccctggcgttctctctcaggagacagcggggtttggctcagacttctgaagtgtttctactgtgaccgtgggcctgggtattcccccaccccgctgtaacctgtggggtggaagccatga

SEQ ID NO: 259591 - DNA, 700 bp, Homo sapiens
tgtgaaaggaagcaggggtgaagccatacatggagagcatggcacttagaagaggcccatgcaacccaagccctgctgggtggacactgagagctggagaactctggatgcatgacaaccccttcccaaccccctgcactaagagacttaacgaaactccagcacagtttctagcagcataaggccctgtcccttggataacaccagcccctccctaaaatgcctgcctaagaaggctcaaccttgccagaaaattttactatttgttctatccaagacatccctgagaggtccctgacttccctttcctgaaatacttactaaaaaagaactttaaattgtaaatatatagctcttgcaatgcagaagcatttctctccaggatctgagagccattcctttggaactgaatcatcaaggatcagacctctgtttctctgtctctgtgggaagacagaatctggacttctttaattgccagctggcagacacagctggcccctctgcatggacactgatggacccttgtactttttcactaatctgacttactgagccatgctttcccctctccctggttttccttttaaaatgtttaaaacaccttcgcacaaatcagaatggagcttagctctttcccctactgtcagcagttactgaatcaaacctgttttcaccactttaactgatctctggctgt

SEQ ID NO: 259592 - DNA, 180 bp, Homo sapiens
tttttcttactattgctttgtctatgcatgctctttttgggatccatatgaattttaggattgttatttctagttctatgaagaatgatggtcatattttgatgggaattgtactgaatttgtagattgcttttggcattttcacaatgttaattcttcattaatgcaattttgtcgacg

SEQ ID NO: 259593 - DNA, 541 bp, Homo sapiens
tccagacacatgaaacgaacctcacagccccacaaggatgccggggagggcactcagtgcttgggatcagagccacgtggccactggtttccgatgcccctttgctagtatctggcttccgtgattcccttgccttcattttgtggctctctcctgacactgccggctgagtgtcttagttaaccagtaatctggcttttctccctccactttgatcttcctgtctctgcctgtctcctctttcctggcatggcatgtgctctcgggctgtacctctggtagtgaatctctggctgccctggactcctgctgtgcacactgccctgtgtgcaggtctggatgcctggtgttccttctcagtgcaccgcccgatcccctgggatctcttcaccattttcatgcatggtgccaccccacgtgcagggccagcttcatggcacgtcacctgtgtgcttgcataggacttggtgctcagaaggacttcttgatgggtttcatgctctgcggccaccgtattaaaattgtaataatttcctcttga

SEQ ID NO: 259594 - DNA, 407 bp, Homo sapiens
agaatatcaccagtgactttacagaattaaaaagtattgtatctatatttatatgaaatattggtctgcagttttcacatgatgtttttgtctggtttggtgtcaggttaatgtaggcttcgtggtgtgaactggcaaattttgctcctgttttattttttgacagtatttataaagtattggatttaattattctttaaatgttggtagaattcaccagtgaagtcacttttttctctgtggaatgttattaaattactaattcaacctctttatttgttatgttttttcgtaattatatttcttcttgagtcagttttgatagtttgtgtctttataggaatttgtcaattctatgtaggttatctaatgtgttggtgtacaattgttcatagcatttcccttgt

SEQ ID NO: 259595 - DNA, 410 bp, Homo sapiens
gggcattgagataccacttcacatctctattaagatggctagtatcaaaaacacagaaaatgacaagtgttggctaggatttggggaaagtggaaccttcaagtattgctaatgagaatgtaaaatggtgcacctgctgtgaaaatggcttggcaattcctcaacaaattaaacagagaatgatccagtaattccactttccagaattgaaagcagggacttgaacaggtatttttatatccatgttcacagtggcatcatatacaataaccaaaaggtgggaacaatatgcatatccatcagcagatgaaaggataaacaaaatatggtatatacatacaaagtgagtattatttggcctcaaaaaggaatgcaattctgacacatgctacaacataaaccttgaagac

SEQ ID NO: 259596 - DNA, 520 bp, Homo sapiens
gcaaatctgctcacaaaaagtatttttcttatagctgactttactgaaagttgggcgagactaaagtagtttacagaacagtaacacaattttcaatattggatatttctagacttaaaggtatgttggtgcccacatcacatggactagacttcctcttatcctttataagagaatctaactttctttcatggaatccaaactcagctctgcattgccaaggcacatttaaagcctcactaagtgcatttctaaatatctacttcaggacttcccaattgtctgtcttttgccagtctcttcaaggggtgtaaaaaaattttactgcactcttgagaaatatctgtgcttcagcacacacacgtgcacatacaccactgtctccacactcacaccccatagaaagtggaagtattgatagtcagtttagtcagtttgggttttaagcaaaaatgtctcttgaatacacttatattaaatatttaaaagtttatagttattataaatggatagtatctta

SEQ ID NO: 259597 - DNA, 603 bp, Homo sapiens
gcaacatggtgaaaccccatctctactgcatatgtacacaaaaattagccgagcatggtggtgcgtgcctgcagtcccacctacatgggaggctgaggtgggaggatcacttgagccccggggattgaggctgcagtaagccatgatcacgccatagcactgcagcctgggtgacagagcgagaccctatctcaaaaaaaaaaaagaaaagaaaggaaaaacaatatttctcttgttccaatctggctttgactgaaagtcgatccttcaggtggctgagttctgaattggagaccccccgcgtggaggccagtcccgggtagggagtagctccgaaatgcatcccaggacactgaaggggagtgccggatctactttgggttctcactgcgggttgagacactacatgggcttctttagctaacagccgaggaagggtctctactccttcgtccttacccacatcaaatgctaattctgatgtgcatccccatcagatttggaaagctgagtggcgttttgcggttttaaaaagaattcttctattccccttgattgttttttacatttttattttatgagtgttatactatttctttattc

SEQ ID NO: 259598 - DNA, 541 bp, Homo sapiens
  misc_feature (534)..(534): n is a, c, g, or t
agattagttgtttgtccccaaccagagaaagtactagatactgcttgtgccagtggccctgccctggatttcattatttttgaaagtgacaaggtttagttttctacccagagttacatgggagttcagagtcaagaaaattgggttcactagtaaaaatcaagtcgtcgtctttacctacatttgtttttttggttcatacctgtaaatatatatttgtgtcatattgttggctaagaagcttctgggtagcatgtatttttaatagaaacatgttttatatatgtggtgttgtaaaattggtttgttttattcaatagtgtgattcagatatcatttctaatacagatatatcattctttaatgactacagtattttatcagatgcatgtactgtagtttatttaaatagttcacaactaatggctgttgagcttctaatttactacttcttttgggggatgagacagagtctctttctgtcacccatgctgagatcgcgccacgcacccagctggtgacagagtgagaccngtgtctt

SEQ ID NO: 259599 - DNA, 653 bp, Homo sapiens
cgctacttcattgggtaccataattagtgttcaaataaatatgcccaaaccagatgaatgggacaaaagtaatgacatttcatgcaaatgtttgttgactctatgagagtaggaggctgcctgtctgtgtcgtttactctatctccacactcgatcttagccagaaggccgagaagcaatcacttactccatctttagtggacatgagaatgtcttgtctagaataggacttaggtaaacatttgttggatgagggggatgaatgaatgaaagaatgaaattataactgctgaagtatggtgtggaagagcttacttaactcttggatttaggatcttggagtacatgcagacaatggagaccactatgtgtctgaaacctaatcaaataaaaaacaggggaaaggaacagaaatctttacctggaagtttagaagccttagtgggggtgaaggatttgtttgtttagtttaattgttgcatatagcttggacactgatggagagagtttacagctttgtcaggtactctgttccttgacacttgtgttcatttagtggttggatgactcaactgtcaaaaatgccaaataagggaatcctgaaggagcaagtagttgaatttactgatctttaagatccatgttgagcccat

SEQ ID NO: 259600 - DNA, 369 bp, Homo sapiens
tccatgccactggctgcgcatccatcagtgacacagttcagctgccgacctctctgtgctctggttttcttacttataacagggggctatggttggaatgtttgtgtccccccaaattcctatgttgagatccgaactcccacagagatagtgttagcaggtggggcctttggaaggtgattaggcaataaaggtagagccctggtgaatgggattagtgccctaagaaaagaagccccagagagctgccttctgccatgggaggatacacaagaagatgccatctatggcccaggaagtgggccctcaccacccactgaggctgactgacagtgccttgatcttggactccccgcctcaagagctata

SEQ ID NO: 259601 - DNA, 324 bp, Homo sapiens
  misc_feature (307)..(307): n is a, c, g, or t
tccatgccactggctgcgcatccatcagtgacacagttcagctgccgacctctctgtgctctggttttcttacttataacagggggctatggttggaatgtttgtgtccccccaaattcctatgttgagatccgaactcccacagagatagtgttagcaggtggggcctttggaaggtgattaggcaataaaggtagagccctggtgaatgggattagtgccctaagaaaagaagccccagagagctgccttctgccatgggaggatacacaagaagatgccatctatggcccaggaagtgcctagngtggcagtcgatagaca

SEQ ID NO: 259602 - DNA, 308 bp, Homo sapiens
ggattacagcacagcaccagaatatcaatctgtgcctttgaggagacagcgggaacagtacaagaggattcaggagcctcagcctgaatcagagacccgacaaatcgcagaatgtatctaccacttggatgccactgatgttgacagctattcttttaaaatactgatattcaacatgacaatgcatgtgacttgccaaggaattgagaagctgaaagtacagtgacatggttatgacagggctgcaaaagacatgacttgtaatgtcatttcaaagctttctctaaaaataagttgaaaaacacaaa

SEQ ID NO: 259603 - DNA, 367 bp, Homo sapiens
tgccttaaaacttactataagactacagttagcaagatagtacagtattagcaaaaagatagtcatatagatcaatggaactgaattccaggattctaggaataaattcttacatttaaagttgttgattttctgtaaaggtatcagtgtaattcagcagggacagtggtggtagggaaattggatggctacatgcataaagattaatcctaaatgttaagagccaaaattatgaaactttgataagaaacataggagaaattgttagtggattgggttgggcaaaaattttttacatacaacaccaaaagcaagatctataaattttaaaatttgatacattaggcttcatcaaaattggaaactt

SEQ ID NO: 259604 - DNA, 437 bp, Homo sapiens
cagggtttcaccgtgttggccaggctggtcttgaactcctgacctcaggtgatccacccaccttggcttcccaaagtgctgggattacaggcatgagccaccgcacccggccctatctcaagcttcttaactgcacctgctaaatcccttttgccatgtaaggtaacgtaccaacggtttcagagattaggatgtggacattttggggggctgtttttctgcctgcaatacctgctctccagtgaatccatgtttagtggaggacaacatttgaggcacttacatggatgctaggggacatatatgtgaatgttaggcaaaagtgctgcctgaagccagaaaatacctttttaatattagtttttttcacccaatttgatgtgttattgtatccaacttaaaatacatgaactaataaaatcagatttttttcaaaa

SEQ ID NO: 259605 - DNA, 513 bp, Homo sapiens
agcgccgcgcctttcctctggcccgggcagcggctcgccccgacctcggccccagacggccttccctgcgcgtcgggacctggggctgcagaggaagtgggcccggcgaggggccagaaagctgtccagggctggaactggagctagtgggctgtgtggttaacgtggagacgtttgctgctcactggacttcgtttttggatatccagtaaaagcaagggtggccttcaccttatggccagctcactcgtccactatcactcagacctaaaaccattgattgattttagtgacgctagctacatttggcagtgggatttaggacatagttcatagtcaaaccccagtttatgtagttttacaaaatgtggctttaattacagtaaagggttatagtagtcgataaagaaacattttaagactggaaaaacgatgtggattgaactaccattaaagtggaaaatggattttaataaaatgtatctttttcaaataaatgctttataatcttca

SEQ ID NO: 259606 - DNA, 899 bp, Homo sapiens
agcgccgcgcctttcctctggcccgggcagcggctcgccccgacctcggccccagacggccttccctgcgcgtcgggacctggggctgcagaggaagtgggcccggcgaggggccagaaagctgtccagggctggaactggagctagtgggctgtgtggttaacgtggagacgtttgctgctcactggacttcgtttttggatatccagtaaaagcaagggtggccttcaccttatggccagctcactcgtccactatcactcagacctaaaaccattgattgattttagtgacgctagctacatttggcagtgggatttaggacatagttcatagtcaaaccccagtttatgtagttttacaaaatgtggctttaattacagtaaagggttatagtagtcgataaagaaacattttaagactggaaaaacgatgtggattgaactaccattaaagtggaaaatggattttaataaaatgtatctttttcaaataaatgctttataatcttcacgtcttggctatcattttctttttgatgtgtgtgtgcgcacttttatccacaagtttaaagcagacctcgataattcctaactatgattttactaccctgaactctgcagggaagtgtcctttaattgacagctactcaccaccttgtttgacagagtgccccatttaaaagtcctgtttgaaatagaatgtagccaggtggccttcagggagtcctgtggtgctggttctctactttctcaactcattgtttcatgttagcaccatgcatgtctaatttaggtgcagtataatttgcggttatctacaaagatgttttaagtctggaaaatagctcaagatagtgattcagcctgcaggtgttagattagagatgcgtgctgcgc

SEQ ID NO: 259607 - DNA, 263 bp, Homo sapiens
atgatgcagtggaaatttattttgtttcatttgtacagttttataaaatacctttcttaaaaactcaaattttcagtttctgtaaagattgatatcagtgatatctttaggaaatgtttggagaaagtttattacagaagttggcataatctgtatctagctcttgtgactttagagcagtattttgaaaatttgtactcatgatttccatttgtagaaattttccaaagtatgcttaatagattgttcatacaaatattgct

SEQ ID NO: 259608 - DNA, 290 bp, Homo sapiens
ggggccctgatttcttaatactcaccccaaaacagctgttcctcaaaacctggatcaaaatgcatatcaacagaggagcaaattatgtttcctgatttctgtgattctctccatttcctgaagggctctcccccgtgttcaatccaggatattagttctggttttggaagtccatcatctgcacagagaagtcagacagggtagtttggcttcctgaatttaaagcacactaagtttctaaatttctcaacattcactcctgggacaaagtatgagaacaacatgtcaaa

SEQ ID NO: 259609 - DNA, 603 bp, Homo sapiens
gggtacactactttatgaatgtatgggactttggttttatgacacataaaaaagacagtgcatatataactggttagtccagtatatgtacattttaaataattatgattctaacagtatggtctccgatgtttgaatatattgtttaagcaaaaatagtccttggaaaggttgcaacgtgatagaggaagagacacaggaaccctattttggagacaaatttccattcagggaagaacttttatagatactcactgaagagtatctaaaagcatcatgcttgcacctatttatctggttttttttccccagatctccattgccaaatgatgtcatcaacccatctttgtataaacagaaaatgaaagagacctataatttctatattttgtcttttgattccaacagcattattattttaggagagaggtctagatcaacagctctaaaatgacaccaacagaacagcagtgaagaaggcattctcggaggctgcacatttctggaagacagcatgaagatatgcctcaagtgcaaacaaatatttggtttggacttagcaattctatttcagagaatttggccctacacaataaaaaaaaa

SEQ ID NO: 259610 - DNA, 455 bp, Homo sapiens
gaataatcacattaattttatcatcttaattggaactttacaaaaaggaaattgagacagtaaaaactgtggttggtgacccccaggacctactcttgctctgcctcggtgaattttaattaatttaatattgtctgggtaaccaaagatttctcatttattaactcaatattatttcaagatcctaatgtcatttatgaacagtaggaattccattaaacattacataaaagacccagcaccatcacagttaacatgaaaaatttgacagcgggatgacatttaaaatttttgtgcaattaatacaagtgtaaagccaagtccaggtggcttgcagcattgcctgaagttcgaaagaactgactctttttttatcctctagagatcacttattaaaattcaacttagtcgacccaaatgtgtatatttttataatctcaaacattatttggaaa

SEQ ID NO: 259611 - DNA, 372 bp, Homo sapiens
gatcccttgagtctaggagttggaggctaatgtgagctatgactgaagccactgcataccagcctggatgacagagccagaccctgtctcagaaaaaaaaaaatgcctgcagtgatttaaacataagtttaacataaataattactgaggtatgacaaaggagtaactgtaagattttaaaaaataccgtaagtctccctaggcctgacggagaggaccaaaataaggaaaagcatggaaaggagctctatccacaaaaatacacttcacactttactggagaaggcatagaagcatcccaatggaaggcacagaagttttctgatttcccaaagacagaactgatctatagttactaggcaagcaggaagc

SEQ ID NO: 259612 - DNA, 406 bp, Homo sapiens
ctcagcagttcctgtcagtcaagggtgagtcccagacagacactaagccaggagcagccaacatgctctaatccacccccaaggagtgcccccatgaccttctcacatgtatactgcctggcccgtgctgcttcaataactgaacatttagcttctctgatcacaacttctgtgctccacaattatccttctacctcacagctaactcctgagcaacacaggggttaggggaactgacccctcgcttagttgaaagtccatgtataactttggattcccccaaaacttaactactaatagcctactgttgaccagaagcctaattgacagtcaattaacacgtattttgtatgtcatgtgtattatatgttgtattcttgaaataaagtgttgtattcttgaaact

SEQ ID NO: 259613 - DNA, 518 bp, Homo sapiens
gccgcattcgtgtcagaggtgaaagcagcagcctctcctcccttgcttcacgactgaccatcgaaatgttctaacccttctataagcattccgacacttcagtcggctttgacaggagttttcatgtcactggacaggtttcttattttaaaaacaagacaaggcaatgaaaccaccaattaacagcagactaacaccacagctaactccacttccttccaaaactctggcaaagcgacttttaaggaaggaacaagagcttctttataagaggctgcttgatcactgtgcataagacagctgtaaggaatcaagtggaagctgaaaacccaaggagattagaaagagaaggggtaaccactgacatcagaattaagaagaggctgggcgccatggctcatacctagaatcccagcactttgggaagccaaggcaggttgatcacatgagcccagaagttcaagattagcctgggcaacatagtgagaggctgtcgactgagagaacctcatctctac

SEQ ID NO: 259614 - DNA, 205 bp, Homo sapiens
aaatcaaaattatgacattgtacgatacattaataatgttcagaatgtagttgagatttttttaagtgtgtgaagaagacatgcagaaagttcagccctgttgagttttattaaagtgtcatttgtattttgtaatatgacagatttaagacacctaggtttgatgcagtgaattctcccatgatgagtacatctgggtggtaac

SEQ ID NO: 259615 - DNA, 398 bp, Homo sapiens
ctgtatagtgtatcattatatgcgtagatcacgttttttaatttattctttctcattgcactgttctgcaatgccaccttgccgtaaaccaggcatctgcatctgaggggctgtttctggacctgtcattctgtttcatcgatatatttatctatccttgtgccaaaaccctactgtcttacttatggctatatcattaacttagctaatgtttagagctatgtaatgtagataattgtagctgtataatagtaatgtatcgatatctggtagaataagttcttctactttgttattcttttaaaactaccttgactattcttggccctgtgtatttccatataacttttacaatcaagttgaaattactccctcccctccaaaaaaaaaaaaaaagc

SEQ ID NO: 259616 - DNA, 396 bp, Homo sapiens
tgttaagtaaactacacaaaagcagagttgctgtttacatacatcatgatgccgtctggacttgagcaccttggcggctcaggattaaggcacctcagtctagcctagcagagttacaatggagagaagtgaaaactcattagtagctcaaaacaagctaaaggatttcagatgctctttttcttgttcatctaaatcaagtcttcatctgtgtcaagaactaaattgttaaagacctttttaatttgcttagtgcaagaaaaataatagcaaccatatatctagttaacttgagtcttctgtgcctctaaaattttgtttagagaaagcctatttctattgaggttgaggaacacaattctaatacttagtaaaattattaacattcattgcatt

SEQ ID NO: 259617 - DNA, 510 bp, Homo sapiens
aaagggaagacagtggttgcccgtattcttcctttcctctccacagagcaagcagctgacattttcatgacaacagccagggacctccctttccttatcaagaaagatgcacaagatgaggtgctgccatgcttactgagtcccttctctctcctcctctatcatcttccaacagtgactatcaccagccttttgcaacagctaatgaacctacctcaaagtgcagctacaccagctccctccaatcctcacttcactgctgtgctccagaacaaattctgactggattccactgaatccctagatcaatttgagaaatgacttctaaacattgggtcttctcatctgtaattatggaagatgtttcaatttattaaggccttccctagcttctctcaacaaaattgtgtaatttttaggtagtagtcttgcatgtgttttgttaaatatattcctaagtattttatgttctttatcaatgaaaatttttttgatttcattttcaattgt

SEQ ID NO: 259618 - DNA, 747 bp, Homo sapiens
tgggggacacggactcgacgggaaggggaacttggcatttatggacagatcctcatccttcttgctgtagtcaattacacgcacgttaaccgtgcagccgccctgctgtattttaggcggttgttggcactcctagttgggcccttccctggcccctcacagcagggcctgcctcctgtggacgcttgtgtgctgccctggcaccggccactgtgttttgcataaaggagaggctccaaagatgttggccaaaggaatgaagccttgagagtccaggctttctatttctgagacactctactcaaggacttcccagatgcaaagcttcatctttgagcaaatacaaatatggagagggaacattaactttctgaagaaaagaaggaacatcttttcaaccttttatattgagttaacaccatggtcttagttttgtgaaagcactttaatacatccaactagcgggaggaatacaagatattcctacctttttattattattattaaaagagggctaaaccatgttgtaaactacttaagaactgaatgttcaagttgtacagtatattggccagattccttactgcccactaggcttgggagcatgttttcagctcagttttatgaatgttttaaatttgtattactgatctttgttatagccaattagcaattcaaaatggtaatttttttagcagtaataaatataccatcccccaaacagtacaataaactttatttgtaaaa

SEQ ID NO: 259619 - DNA, 606 bp, Homo sapiens
cttgtgagtttattttatcaacttaaaataaagggacagagaaagatctattaggcaaatgaaaaacaaaaaaattaggggttgctattttcatgtcagataaaacagactgtaaaccaataatgatcaaaaagaacaaatgagggcattacacaattataaaatattcaatccaacagaaagacttaactattctaaatatatatgcacccatcatccaagtacacgtatacataaaactggtttttcaagatctattaagagatttagaaaaccacacaataacattgggggacttgaaaaccccactgatggtattaggaagatcattgaagcagctaaccatgatattcaggacttaaatttgacacttgaccaattggacctaatagacgtctacagaacactccacacaatagaatatacattcttcatatatgcacacagcatatactataagattgaccaaatgctccaccataaagcaagtttcaacaaattcagagaaattgaaatcatataaactatattctcagtccacagtgcaataaaaatagaaatcaatgccaagaatatctatcaaaaccatacaattgcatggaaacc

SEQ ID NO: 259620 - DNA, 591 bp, Homo sapiens
ctcctcttggtctcccacattcagtacctccttcttcaccttggtctcttctaagcctccgtgggtgcatttcagggattaaatgagttaatagatgtatagtcagcctccaacatggttccagtaattctcacctcctggtattgtgtctttgtataggcccctcccacaatggatagggctgacctgtgtaaccaacaggatgttgcagaaatgacatagtgtgacttcaacactaagtcacataagacatcgcaacttctgccttgctcttttggagcacttgttgtagggaaaaccagctgccatgtcataaggacacttaagcaatgctctggagagatctacatggcaaagaactgaggcctcctgccaacccccagcacaaatgagccaggcatgcaagacatcatcttggaaagggatcctgcagcctcacttgagccttcagatgatgcagctccagctgacatcttggctgcaacctcatgagggaccctgggccagcaccacccagccaagctgctccagacacctgatccacaaaaactttgtgagataataaaataaaatacattttaacattttttg

SEQ ID NO: 259621 - DNA, 1003 bp, Homo sapiens
tccagtgctacagggtccttcctcttgttcctgtgttcttattccacagtgagaaacctagaaagaaagagaatgagaaacatgaagaaggagtaatttgttgtctaccccaacattccttccttgacaccagtacttatttcccaatagaaaggctggaaatggccaacactgcttttccaggcgtccctgcagaaaggcatgcatgtgtgacttaatcatggccagtgagacgagaacatatgtcttcagagagccttctgggacagattttcctcctggttctgggtatgaagcttgctcagttcagtgcctgtgggattcactgataagatgaaatacactgatccacagcttgtctgagatgaatgcatgtgctgtgtgatcctgaagttctttatgtctgttggcttttcatagtacatctgctggaaagaagagcctttttggacatttgtaagccctttgtgatgggaggggagtaagtctgtaagtatgtgtgaaaaggggctgctgtaatgtaaagccaactcaccaaacatgggctttgcagtaataaggatgggaagctaaagatcagacctcatggaaaagaatttccccctttctttgacttggcctataaatgtagcttttctgactcttttgaggccctgttgcttgtcttgtattcagcacctaataatgttgttgcaaatgtcaggactgcaacaagctcagttgtgttgtagcaagtaggagactgctacaaaatgggaagagtcactaatagttttggcaacaaaacatgacaatgtgcatattaccagaggcaattatgtgcatctcatggggattcaatagactctgggactgactttaatgacctgaaaatccacttgccctttttgttttctctgttatgtccaagtaatgaaaatattgagaaagttattgtaactataaaattgcagcatagttccttttttaaaaaaataaagcctgatctatcttttgacttgca

SEQ ID NO: 259622 - DNA, 460 bp, Homo sapiens
taaagaatacttgataatgtaaccatgtgggatattttagtaacaatggtagggttaatgatctgggtttaacagatcaggaaacagactcagaaagtaccactgctgaaggcttttcttctgtcttcatttctcccaagaactccagatacgaatatttgtttgtctgtttgacatgtctgttcacttgatcgtttaatagtcatttcgtactgcatgtgaaagtagagctctgggttttctcctcaccttgccattttgcatctactacagtcttcagctcagtgaatggtcatatgaaaaaatctgttattcatctttaattcctttttttactttactcccagaaccaacgctttagcaagtttatttttttatttttattttgtttgagacggagtcttgctctgttgccactgcactgcagcctggggacagagcgcgactccatctcaaaaaa

SEQ ID NO: 259623 - DNA, 542 bp, Homo sapiens
ttacaaaggagcatgagtagaacatgtgaaaaaacacaaatattagtttttccccttataccagtttgccaaattccttttagaggaaactaagctctgtagtgccttctctttgatacactgagctagcaagagacttattaacgttaagcctgtaaagtgggtgtttcttcattctaatacagaggtaagaggttccagtctgacaccactacggaataaaatgttgaggcaaactcagttacaaaatatatttggcatctgagaacacctcaagactctgtagaatcgctaagcatttgattaatactaaaagagttgtaatgttttgacttcatgcataattacaaaatgaagcagggtcatttttcaaggctttttgagggggaagaggaggtgcataaaactccctttttaaccacagtaagacatacacgcagagcttaaactatcaccatctgaacagatagataagtaagatactaaagtacaggtgctctcaaatacacaagtaaactgacttgattcttgactacccagca

SEQ ID NO: 259624 - DNA, 372 bp, Homo sapiens
atcacctccacatcattattcttcaatggtgttaaacatgtcctcaaactaaagcctacaacctccttgcatgagtcctggagaaattctcatccactgtctcatcccagtatcttttatctcccccagagagtggatgtttcagaagcatcccagcctcgtcttgagttttcttccctgagctgctgtctctgacctactttctttaccaccatctccccttctctccccgtcttggctcataagtgaatggggtattttctctgcactgggaaagaaactagatcagagtcttctaagcttgaatctgatatgtattgggagttaaggaaattcagactggtcttcaagattactgtcttgaccactaaa

SEQ ID NO: 259625 - DNA, 390 bp, Homo sapiens
cctttatagaaaaccctgaggttttccaaagaaggggtgattctgcttcaaaactgcaaccctgtctgagtttccagcctgcaaacaccagattcaaagctgcttcagaactgcaaccctacctgagtttccagcccgcaaacaccagattcaaagctgcagcatcaactcctccctgagtcttcagcctgacaggctgctctacagatttcagatttgccagcccctacaattctgtgaatcagttccttaaaataaacatttctctctatatttatgcaaatggataaatgatggatagctgtagatttcactacatagatatagatatatagatcaaggagatctcctattggttcaataaatctattggttttgtttctttgaaga

SEQ ID NO: 259626 - DNA, 670 bp, Homo sapiens
gagcatattacgtatgctactaactcaggacctttgcacctcctgacaactcttaggaagctcttgccacagatatccacatggctattcctttacctcattcaaaacttgtctcaaatgcaccatactaagggaggtctttgctaagccatcatatttaaaattgcaacgcacaccacttgacagacagacacacagacacacagacacacacacacacacacacacacacacacacacacatacacatatactccttagcccccttcccttgcatcattcttctccacagccctattaccatctcacatacttctagtttacttaggactgaaatgtaagctccatggaggtaggcattttcttctgttttgatccctggtatatcaccaggacctagaatggtgtctaacacatataacaatcaataattattttttattaagttggtggatccattaagaagcaagagagatgaattaaagtctctacataaaaaatcacccaaaatcaatcttcagtcatctccctggtcttctcaagggttgttattacccaccttctaatatctattgataatagctattaggtaagtgtatttgtaggggccaggagcagcccttgccttctcatcttcatcacggatgagataaaatatacacagaagccg

SEQ ID NO: 259627 - DNA, 200 bp, Homo sapiens
ggatgagtagaaggaaaaaatagaaggaaagaagggcaatgaaaatgagacgtcagagcaggatgaccctaaaatcctaagacggcctgtcctggagtggactgtttccctcgaacccttgtggtcttcttttaaccatcagcatacccctagtggtgagctctgacaaaaatattaaacctggaaattgttgctgtgat

SEQ ID NO: 259628 - DNA, 419 bp, Homo sapiens
caaggcagtaactacgagcccctggaagaatgagcacactgggactcgggaagggaccacttacaagaaaggtctgaatctggaagaagcaaaggatcaagtcagacgtgtgaagaataaggagcccgtggatctagagagaaagaacatttttctgtgaagagtttcccctccttatcctctctccctgctacatttaggtagacccagtgataaatagcacctgccagccatggtaggcatgaccagagtggcaggcggcctgtgcatagggtgctggatgagggcagaggcacccatggaggtgcaagcctgtttcgctgcccctcctgaccccagcatccctagccaccagtgtgatgtgagtgcctccagagggcaggggcagagaccctgcccgccccttctcctgtcctctg

SEQ ID NO: 259629 - DNA, 708 bp, Homo sapiens
gccaggtaaactcctgcctgcttttgtgtaactctctcagtaaaagatattaccagaccctcccctcacccgattccttccataggtttccttagtctgtccaactatcttcatacccagggctacccctctgctttaggctctcatcatctctgacttggattattagaacatcctttcagtgaactccctaataaccctgctttatttaaattttcataagttgttcatcatggtttttttgcattaatttgattttgtaaaatattgcattaaaatttcatttatcttgattcccaaatattttggtgcctccttaaggtgtgcacaaaaagcaagtgctgtcctcatttcactcttgtcctcgcccttctcctacctccagtcttgtctccctcaatctgttttccatttagccaggcagccagtcaactaaaatacgtaagtaatcatgccacattcctgcttaaaattcatcaaagtattcccctcaggttaattccacaagacctcaccagatcaatcttgttctggtccctgctttctatttcaacctctattctggatttcctctttttcctctatttgtcattgccatggctaacatcatgtactgacacagaatgaacacataatgttcttagagctttacatgtattactttattctatatgatgaggtgatacagatactattatattatttctg

SEQ ID NO: 259630 - DNA, 604 bp, Homo sapiens
ggtggggtcaaatgaaccagtgcaaggagagtgacatggacaaggagagtgtcctggcctgatcctgatggatgtcaatgacttccactgaagagtcttttatttgggcagagccttcagcctcagatgccaggtgctaatcacaagtgacagcataaccgtgtctatcaagatggccgtcttgagctggtgaagtcttgctattcttatggccccggagtcttctggtgaggactgaattgatagtaaagagtgtgcctggttatgtccttatctgattgattgctgtctctattgattaggcgaacatctgatcgctgttggtatgatgcctgttggtatgatgcattctgaaacataagatgagtctttttctaagatggagttacagatgtcaagggtgctctataaacagcaccattcagtccttcaacacttttcacaggtatatctataacctaccaatagaccttattgctaacaatctcctcccctgtccaatccatacctcagcctgaaagttctttctagaatactgattaatcatgccatttgtctgctttttggagaaagttagaacttctgagaatggatttcaaagctt

SEQ ID NO: 259631 - DNA, 668 bp, Homo sapiens
  misc_feature (559)..(559): n is a, c, g, or t
  misc_feature (587)..(587): n is a, c, g, or t
gtaaaggtgatgaagtagcagaaaagacataaaaaaaaaaatccagaaagtaagaggaaaatcaacagcattcccaaaagaggacatttaatagaattaactctctttcacacacacacatcccccacgtgatgttcaactctgttaaatgctgcaagctctttaaagaaaataaagtcaaataaattttccttggtttggcaacatgagggtaattggagacactgataaaaataggtggagtataggctgggtgtggcagctcatgcccataatcccagcactttcacttcagcccatgaatctgagatcagtctgggcaacatagtgcagccctgtcttgatagatagatagatagatagatagatagatagatagatagatagatagatagacatggtgtcatgtgtctgtggtcccaagtagttgggaggtggctgaactgggaggatcacttgagcccaggaggtagaggctgcagtgaaccataatcatgccagcgcattccaacctgggcaaaagagtgagaccctgaaaaaaaaaaaaaaataaaaaatncactggcccgtggttttacaaccgtcgngaactgggaaaaaccctggcggttccccaactttcgcctttgaggaacatcccccttttcgccaggttgccgtatgcgggg

SEQ ID NO: 259632 - DNA, 374 bp, Homo sapiens
cagtcccattactgctcagcacaggagttttgacctgctccatttccaacctgggctggtcactccctccttaggcaacctgttggtctcctgattccaggaggtcaccatattgatgctgaacttagtgtagacacccaactggcatagtgcactacagcccagaactcctgggctcaagccatcctcctgccttagcttcccaagtacctagactacagacgcacaccataggaacctcttagtacttgtctagtttatacccctcagttaaataaacaataagaaattaaatgacaaattcaagggcaaacacagatttacattcagagattactggcagattatgtaggctactgtgatttcactagaga

SEQ ID NO: 259633 - DNA, 937 bp, Homo sapiens
gaccttctgatccgagcgcttcagctcctcccaggccttagccgcctgctgctgcagctcccgtatcctctgggccttcttgagacgggtcagcaccagggccacaatctgctggtcctgggaggacaccaccacctcttccagcttgctcttcaggacctgggtgtgcgggctccgcatctctttgctggaggccaagggctgggagtcccggctggctaatgactcaacctggtcgctgctgtctctcttctgggcgcacacgcaggctgagtgcctcttgaacttttgcgagggcacagaagaccgctccgagggaactgaggaaggggaccagcgacctagatgtctgccgagtggcactgcccactggtctccaccctgtgccttttctaccctgaatgtgccactcaggggagtgccagctcctccggggcaaggcgggggcgagtctccctgggccagagggtaatgcgggcagggctgcggccgctggggtggcagctgggtctgcggctgccaagccgggcggggcttggttcctgtctctccccaggcatcttccaggcgcctgctgcggggccggtgcttcctggaacgttccaggggcctgcgggccacatcgctcaggcttcggctgccccgcagtgaatctgagcacccgcgcctgcgaggccgcggggtgaacgaacagtgcgggtgcagccagcacgccccagcttcgctctccgcacccggagtcccggcccgggagcacgcggtggagtcggctccggacctctgcccgcccagccgctgcgtggactctcgttctccgccgggccgcgggggttcccagagatcccggtagggcggctgggagaagtggctgaagcctgccatccctccctctgggcacgcgcagcgtctgcccaaggggcctgagacctcccgagga

SEQ ID NO: 259634 - DNA, 392 bp, Homo sapiens
gtaccggggagcagaggacgtcccggcccgggggaagtcgctggggacttgggacgggatcccaggaggtaccggggagagggggcgtcccggcctggttggggtcgctgagggactcgggcagcgggtcccagatcccgagacagagaagatgtcccagcccggggggcgtcgcagagggtcttggaagactcaaggcggagagggcctcctgggctgaggggcgtcgctgaggagcaccgggtcctgcagccgggggacagtaccgggcccgggggcgtcgatgacgggcctgggggtagcccgggtcccaggaagggaccatcccggcctgaggggcgtcgcctaggggcgaggggaaggggcccggaaggtcctgaagcgggagggag

SEQ ID NO: 259635 - DNA, 398 bp, Homo sapiens
ccaatttctgctgatgccatttccctgctagctctggggactccctttcctttgctgtttttgctgtcttctagccacatatgtctgctttcttgcctgttaataccccaagagttcttgcctctgagcctttgttcaggacggagcttgggtccctttgctaaaatgtgtttttaccttgtatatttctattgcagtccttctccaagctcactttctctaagatacttcacacatctttctgctatagttggtggcacttcattttagcttcattttagcacttctcataatctgaccttttattaagtcgggttcatagacatctctgtttctcactcaattgtgaatttctgaggggcaggtgctggcatgcaattactgtggtacccactcca

SEQ ID NO: 259636 - DNA, 443 bp, Homo sapiens
gtagagctctgtagttagactgctttagaatcccagctctaacacttacgaactctgaccttgaacaaatgacttacctaagagctttcttcatctttaagttggtgataataatagtacctatctcacacggctattgaggttaaatgatgtaatgcatgaaaaacatagcttggtacaaactaggtacttactcagtaaacagctgttaataattattttctccctgcctccaggattttgattttctaagcttgatgtttttggaagtcttcttgattagaaagatgttactatatttgaaaagggaatagagtcaactagagtcatattgcaaattttatgtgtctgagagtgtaatgagaatttgcagcatatgtaaacaagtagatttatttttctgaggtaggtccatggattgttaacagtggtttagggaaggt

SEQ ID NO: 259637 - DNA, 379 bp, Homo sapiens
acttagtctctgtcctcaaggagtccccaatgtctatgtactcagttcactcccactttaaatcagatggatgttggtcaaagggtacaaagtttcagttaggcaggaggaataagtcttcaagatccattgcacagcatgttgatcctagttaataataatgtattgcatatttcaaaattactaaaagagttttaaatgttctcactacaaaaaaataagtatgcaaggtgataaatatgttagttagcttgatataatcattccatggtgtatacatatatgaaaacatcacattgtatccataaatatatacaattagtatttgtcaattaataataaaattaaaaataaattaaatggagcagtcaatgtatta

SEQ ID NO: 259638 - DNA, 584 bp, Homo sapiens
cgtgaaccctggaggcagagcttgcagtgagccgagatcgcgccacggcactccagcctgggtgacagagcgagactccgtctcgaaaaaaaaaaaaaagaaagttttaattttttccctgaaatatctcatattaactccacagtagtgtgattatgaggcctgtccccattgagtgagagtatttgctcctgtggtcagaaagcatcattatgtatagcttgattaatggttagagaagttgaatatataatattagatatacatggatacatgctgagtattggttataatttagggctttttcccaagttgatgactgtgtttgttactttaaagtatctcccaggaagtaccaggaggtgtcttcttggacacataacttcatggacagctccttgtttagcttcactggctcatatactagaaaattaacctttgaaatgaatgaacgtagcacaagagttatattctggtcctgagaagcgcaatgttgatttaatattattagtgagtccggtcatttcctggatttatttcaaatagaatcagtcagtctcaatcccccctccctctctggtccc

SEQ ID NO: 259639 - DNA, 483 bp, Homo sapiens
gctcatttttctgtgagctgagtgaagaggcctcttgtaggcagctgtcagagctaatgaatgttttccaagcgccaaacctctggggaaggcagccccacccagaaaacccagactcaactgatgggagctgtcatctcaaggtgtgcggcaccctgttgacgctgtgctacatgatataaatggtgacatgtggccgggtgccgtggctcacccctgtaatcccaacactttgggaggcctaggcgggcagatcacctgaggtcaggagtttgagaccagcctggccatcatggtgaaaccctgtctctactaaaaatacaaaaattacctgggcatggtggcgggcacctgtaatcccagctactcaggaggctgaggcaggagaatctcttgaacccaggaggtggaggttgcagtgagccgagattgtgccactgcactccagcctggacgacaagagtgagactctgtcaaaaaaaa

SEQ ID NO: 259640 - DNA, 314 bp, Homo sapiens
ctaacttaatatcttactacaagtgactatagaatgagaaaagacttagctaattttaaaaacagtatattttagtagtgtgaaacccacctgtcgtcatcaatgtaatatgccctcccatttaaatccctaaaagctaaggaattaatgcccttaattagctgggtgtggtggtgtgcacctgcagttccagctccctgggaggctgaggtgggaggattgcttgagcccaggagtttgaggctgcagtgagctgtgatcatgccactgcactccagcccgggtgacagagtgagaccctgtctcaaaacaga

SEQ ID NO: 259641 - DNA, 1022 bp, Homo sapiens
  misc_feature (111)..(111): n is a, c, g, or t
  misc_feature (114)..(114): n is a, c, g, or t
  misc_feature (122)..(122): n is a, c, g, or t
  misc_feature (262)..(262): n is a, c, g, or t
  misc_feature (270)..(270): n is a, c, g, or t
  misc_feature (274)..(274): n is a, c, g, or t
  misc_feature (280)..(280): n is a, c, g, or t
  misc_feature (287)..(287): n is a, c, g, or t
  misc_feature (296)..(296): n is a, c, g, or t
  misc_feature (302)..(302): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (318)..(318): n is a, c, g, or t
gccaaagacctttccatccctccacataacccgggggatttatatcccaaaaatccctgtgtctgggttgcaagggggatgttatttcctcatggtgggccataaaaatgnacntgcccggngatttcctcagcaaacccacaaccacttgagaaaaccttatggacctgcatggatagcctatggacattcatttgcggtggagagtgagcacgaacaagcgatggctgcttacttcacagcagcacagctgatgaaaggntggaaacngccngaaaantgtttcntgatgcttnggaaanantnaanccantnggnaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatatcggagcagacattaaagacaaattaaaatgttatgactttgatgtgcatacaatgaagacactaaaaaacattatttcacctccgtgggatttcagggaatttgaagtagaaaaacagactgcagaagaaacggggttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 259642 - DNA, 1192 bp, Homo sapiens
  misc_feature (111)..(111): n is a, c, g, or t
  misc_feature (114)..(114): n is a, c, g, or t
  misc_feature (122)..(122): n is a, c, g, or t
gccaaagacctttccatccctccacataacccgggggatttatatcccaaaaatccctgtgtctgggttgcaagggggatgttatttcctcatggtgggccataaaaatgnacntgcccggngatttcctcagcaaacccacaaccacttgagaaaaccttatggacctgcatggatagcctatggacattcatttgcggtggagagtgagcacgaacaagcgatggctgcttacttcacagcagcacagctgatgaatagggtgtcatttgcctatgctgtatattggattatgaatatggtttgaccaataactctaataagctagacctgaaaggttcttcagccaagctctgagcattgcaccggaagacccttctctgttatgcatgtaggtcggcagtggattgtcgaatttcacgaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatatcggagcagacattaaagacaaattaaaatgttatgactttgatgtgcatacaatgaagacactaaaaaacattatttcacctccgtgggatttcagggaatttgaagtagaaaaacagactgcagaagaaacggggttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 259643 - DNA, 498 bp, Homo sapiens
gctcctaactccaccgcctatcccaaaacctataagaactaatgataattcccgccctttgctgactccttttttggactcagcccactagcacccaggtgaaataaacagccttgttgctcacacaaagcctgtttgggggggtctcttcacatgcacacgtgaaacatttagtgccaaagaccagggtcagcgggactccttcgggagaccagtcccctgtcctcatcctcacttcgtgaagagatctacctacaacctcaggtcctcagaccaaccagcccaaggaacatctcaccgattttaaatcgggtaagcggcctctttttactcttttctccaacctctctcactatccctcaacctctttctcctttcaatcttggcgccacccttcaatctctcccttctcttaatttcaattcctttcattttctgatagagacaaaggagacacattttatccgtggacccaaaactccggtgccggtcacggac

SEQ ID NO: 259644 - DNA, 617 bp, Homo sapiens
attgacagcatctcactctgccacccaggatggagtgcagtggtgtgatcatggcttactgcagcctctacctttcaggcttaagtgatcctccggcctcagcctcccaggaagctgggaccacagcacaataagagattaacataagataacataagattaatacaataaatatttactgatttattgtagagatgggattcactacattgcccaggtgaaataaacagccttgttgctcacacaaagcctgtttgggggggtctcttcacatgcacacgtgaaacatttagtgccaaagaccagggtcagcgggactccttcgggagaccagtcccctgtcctcatcctcacttcgtgaagagatctacctacaacctcaggtcctcagaccaaccagcccaaggaacatctcaccgattttaaatcgggtaagcggcctctttttactcttttctccaacctctctcactatccctcaacctctttctcctttcaatcttggcgccacccttcaatctctcccttctcttaatttcaattcctttcattttctgatagagacaaaggagacacattttatccgtggacccaaaactccggtgccggtcacggac

SEQ ID NO: 259645 - DNA, 300 bp, Homo sapiens
aaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgt

SEQ ID NO: 259646 - DNA, 679 bp, Homo sapiens
gcatgtcatcatgcccagctaattttttgtgtatgtgtgaagactaggtactatgttgcccaggctggtctcaaacttctggtctcaattgacctgccacctcggcctcccagtgtgctgagattatagacatgagccactatgcctagctgaagcttctgtttaaatgtggcattctcctacacaaaaattataggccagtcatcaagatacacattctgccatctaggaatcttaagaaagaaagagataagagtgagagcaagagagagagaaattacacacacaggctacgccataccctacaaacaaagaaacttggtctaaactgctccaaaagacaagggaacaaatgtttgtagaaaatataagaatatgcatttcagataaacataagaaaagtttttctaatgttaactaccccaaaaatgacgcaggcttcctcactaatgagtgagtttcacatctcatcatgcaaggaacagttaagctagcacagcacgttgaggacaaacagcagaaatggctggggtggaggtgggagcacacagagcaacttggaccagagcagcagggagatgggtgcagggaggcctgagggaagtcgctgaggccatagcaacagaaaatcccaaactgattcacggaggcagataggcattccagattaactcacctg

SEQ ID NO: 259647 - DNA, 689 bp, Homo sapiens
ccacactccagcctggcaacagagtgagactctgtctcaaaaaaaaaaaaaaaaaaaaaaattaggtccagtcaaccgttgtacttgtcagtattaattatttttgctctatctgtcctgatggtttgatttttctttttattgaattattatttatacacagtaagatgtacagtcttaagtgtacagttcagttttgatccaggctttttttttttttttttgagactgagtcttgctgtgtcacccagactggagtgcaatgacacaatctccactcactgcaacctctgcctcctgggttcaagtgattctcctgactcagcctcccaagtagctgggactataggcatgtgccaccacacccagctaatttttgtatttttagtagagccaggatttcaccatgttggccaggctggtctcgaactcctgactcaagtgatccacccgccttggcctcccaaagtgctgggattacaggcatgggctgctgcgcctagtcccaggcataaattcttgtaacccataaaaacccttttcatttttattttaaaaatcttggaggctggacgtggtggctcacacctgttatcccagcactttgggaggctgaggtgggaggactgcttgagctgaggagtttgagaccaacctgggcaactgagtgagacttcatctctactaca

SEQ ID NO: 259648 - DNA, 102 bp, Homo sapiens
  misc_feature (62)..(62): n is a, c, g, or t
gaaggtagagaaggctacgtggtgggggagggtggggggagggtcgcggccgcactggcagnctccgggtgtccggccgtgtcccgaggaagtgcaagaccc

SEQ ID NO: 259649 - DNA, 489 bp, Homo sapiens
agtgtttggtcagagccccggaagggcgggaacggccatcgcagtgagatttcagcagggagtgcatctctaaggaggctgaattcccccatgctgaattctgctgagctgggctgcacgctgtcaccagacggttcttgaccacccagacttatctgggctagcaggacggttgaagaccacaaaaccacgagtgtgcacgctgctccctgaaatactagtttgaggcctcacatggctctcctgttcatagaataactgcagataactcacatttagaggtatttggtatctccagctaactcaactggattttctgtacattttcccatcatttgagcccaggcagggatggaattttttaaaagaagttttataagaagattcacttatctttccagttttacaagaaaaagtccattttctttgcatgttattttaaaatagcaaactaattcttttgtttgttttgtttttgagataggtctc

SEQ ID NO: 259650 - DNA, 443 bp, Homo sapiens
ctttgctacctggcccttcatatgcaaaaggatggccttatcttaatttcagatgatttctgctagactcttcctctattaggcctctgccaggcttctggtttgccaaaggcaggagccaatagctagtcaattgtgatcaaccccttgatttggaaaatctgactgccttgctatgtcccactgccattttccttagggagagagtatggccatttaccataatttacttttttgtgatattcaaaatacctcagttggctgagaaaagttggtaaaattttcctgaaaaacaatttagcaatatgtattgataaacctaagtatggttcatacatactagcttcagaacaagtaatgtgtcccaaggaaataaccagagatgtggacaaaagttttacccagaaatctttttcatggcgttatttataacaccaaaaaaa

SEQ ID NO: 259651 - DNA, 928 bp, Homo sapiens
ggttcataatgttttaaatcagtttccctcttctcttttcaacgtggggtatgttgcacatagcattttgaaagtacgcaaagttcttttggaaagagctttatgataccttattgtcaccgtggtggttacgcttaattgacattttatgggaagtcctggtattatttcctgggctctttctgtttccatcttttagtctttctctttccccttatatattctctcactgccccgctagcctctccatcctctctacagaagcctagtgggcttgggttcctttaagcgggtccagtgagcaggcgcctgacccttgattgaagctcaggaagggccagcctgctctcctccccttttggaggccagagaggagagagctgtgtttaaatattaggagctggcagcaggggacgctgcggagctcttttaaaaagcacactcttctcacccaccgctcgatgccttgggccctgaagactgagttctgggcccaccttcagattgttcagttgatgttttatttgggcagcgtgactttctgcagttaaattgcgcattgtatggaaaactcttctgttcttgtccttaaataaaaagactgaaataagcaaatactcagatcggcacaacccccatcattaccaccaccacgcacacctctctgatgtgtaatgaaacctgcaggcataattggttatgtaatatgctgataatacaagtttcggttttcgatggaaaccagatgtggagggactctctttaattgatccagcaaggggaagactaatagatgaactagtccttgcaaaccccagtggtgttttgatttaactttaggggagaatcccgagctcagggctttggagaggtttttaccctcagcttctgctttgctgcagctgtcctttttgtcagactcttcctc

SEQ ID NO: 259652 - DNA, 270 bp, Homo sapiens
caaagacaatattatctcacagatctacctaactttatcagattagagctttatgtcacaacaaaactctgtcttcttcactccttcgttttttcaccattgtcttacaggctatagtgtggggcgacccacctaagaaatgcgtaacaatgattcaatttttgggccacctataaattattgcctatataaagacagggctgaaactctgaatggtacacgtttccatgctttaggttaaatcaaatcctcaaggtagagagtccctct

SEQ ID NO: 259653 - DNA, 477 bp, Homo sapiens
gggataaagaataccaaggtctttatactattaggccttggaggtatatggtttaaagtttaaggatgaccactggaggcatagcaccagaagatttaacttcaacttccaaagtaggggccctggtgggggaggggaggggcatgcgtgcgggtgtgggatgtgttgcagaggagttaaagcttgacgggcttagaaggtggaaagggtcgagatgcagcagagaacaagtcaatggaaagcacaaaataggatggtagaactaaaagcacagtagatgtaaataaacttaagagttaaaactcttaaggctcaaattctagctataaacgattgccaaactaaacacttaagagtgtaaacaattactataggaaaaagactttaaagcaaaaagcccattagagatagaagttattggcctaaagaatgattgttcctctgggaaaacacgatggtgataactgcaccaagcaa

SEQ ID NO: 259654 - DNA, 480 bp, Homo sapiens
caggatttatgggtcccctttacgctgagctgtctacccctgttgcctaaatgcctttcctacctaacagtagctgttcagtgggtgcattggccctacagactctcccaagcttctttctccaccagtagaagtagctatgtggccttgtgaggtctcccttctagaaagaacaggtagcatgcctctgacaaccacgttgaccaggtgacctgcaagcatccccaggatcaactagcaacctaagatttgctgcccaaactaatgcttctccctgtccagtggacacttctcaactaggctgcccttctgtgtcactgctgctacttagtcactcgttgactttggaagaagaggcccttcagaggctccaatgaccaagaacattcccttccctactcctcagtgtcacgccccgcctcctcccaagcatcaccatcaccaaaaataaaactgccttggtatccttgctgtagtcca

SEQ ID NO: 259655 - DNA, 287 bp, Homo sapiens
accacggaagctgtaaaggaaatgaggtggggtggtcactgtgttccatcccacctcatgtgacatccagtgtgacatgaggcttccacaaccatggatcatgagtccctgatgccaccctttgactctctcaggaggggaagagaggctgctgccacactgagcttctcgatcctttgctttcttggttctcatttttctcctccaccttcattcaagtcacccccctttcttcaccccatctccccaggtacccaagaaacaattaaataactgtttaagcatgt

SEQ ID NO: 259656 - DNA, 442 bp, Homo sapiens
  misc_feature (259)..(259): n is a, c, g, or t
aggcctcacggagatgctaggcctcacatcccccttctcatgatcctcactgtgcacttgacataggattaggcatactggagatgagaaaaggctgccacccaaacccaaggcacctgaccacatctgtaaatatttctgaatagtccacaaaatttcacataggtagtctgattagatcttgcctttgagagaagctgaagtcacagatactgttgagagatttctgccctagagatggcctttgtatatggggggntggtggggggacacaaacacatcagacatccgtcctcacactggcaggacggtgttcatcgcattctcttctgtgaccacctctaggctagcggctgcattcgtggtctgtgcaaacattcgtggttctatatatcagcagcaagtgtgcaaaataaaggacctgttaactcagaaaaaaaaa

SEQ ID NO: 259657 - DNA, 382 bp, Homo sapiens
ctattgacagttgccctccacaaagaccacctgaaaaagctgttgattaagcaaatttaagttgattagacttactgcaataaggagggaatatcaacttgaagtagtattagtagtgtctcagtatgaacaaattggaggatagttacagagtctgatgacctgatttgtgtaatattaaggtaggagttgtaatctgtgtaaacgcctaagattaggaacaatttatgataaagtggctttgaattgattggcaatgtgaattaagggtcttgaaataagtcttgagcaatctgttagtcttgataagaaagctattttaggatgggtgcgctagctcacgcctgtaatcccagcactctgggatcgagaccatcctagc

SEQ ID NO: 259658 - DNA, 984 bp, Homo sapiens
  misc_feature (17)..(17): n is a, c, g, or t
  misc_feature (905)..(905): n is a, c, g, or t
gctgcgcctactactancgggtgctgcgcctactactaccgggggcgtgtctggagggcaatggtaagttttagatccgtgtcatactagatcctgtatcaaaaagcctcaaaaggcctgggcattctgttttcttagtacgttactctagtgaacagccacaggtcctttggggaaatatttattgcataatactcgtggtacagttggaaggtcttcaaagaaacccagactccccttaacttgatggattccagatctcagaactggctcagatctggaaagcagcagcaggattgcaatttcccattgtaacagccggtatcagccttctcatcaactcttgggattttttgtttatacaaatcaaagccttatcctgttggctgaaagtttttgttaagaacaccaagggttattagtcaatgccacagttctctgtgggtcaagacaccctagtgggctgtgcacagtggctcatgcctataatcccagcactctgggaggctgatgcagaaggatcgcctgagcccaggagcccgagaccagcctgggcaacatagtgagacccagtctctacaaaaataaaaattagctgggcgtggtggcacacatctgtggtcccagctactcaggaagctgagatgggaggactgcttgagcccaggagttggaaactagcctaggcaatataatgagacccctgtctctctgaaaagaaaaaaatcctatacttggcgaggaatgatggcctacagtaaatgaggtagagctgctaaaatgatgagcagagaaagggtgtcagcagactcagcgtgtgttaaaatgaatttcttacacgagatctgagaaccaaacacctatgttatctcggaaggcccaatagcttcccgttcactcagacnataaaggatgaagtgaggggagcaccgggattgttcagtgacagctgcctcagcaggttacagtagtagtagcggcagc

SEQ ID NO: 259659 - DNA, 488 bp, Homo sapiens
gacatggccatagggtgagtctgttcccactgggcccactgagatggatttgggccaggactccatttatcagctgaccgtgtctggagggcaatggttcatcactctgctatcttctcctggagtttacacaagcccttcagagtgtaaacaccgatgtggattcaatcccacttccggagagaggatcaaaccaggaatctaatacaactgaaaacggagcctgagccaggtgtatcacgcgatgcactgggctccagcaggattacccctggaatcggcgtctgcacccactcccagccctcgtgctaactgcgtacgcttagcagaatttctctgatccttggacccagctgcgtaaaaataaacttcctctcctgccacgggcgcgaataactgtgttaacatcaaatagaaacgtctgggagaaataaaaactgatgcggccgtattttttttggtgcattatatatatggttgaaaacaat

SEQ ID NO: 259660 - DNA, 1008 bp, Homo sapiens
  misc_feature (929)..(929): n is a, c, g, or t
ttccctcctttacctcaacgccagacagcacccctcgacagccagctgccgctactactaccggcggggcgtgtctggagggcaatggtaagttttagatccgtgtcatactagatcctgtatcaaaaagcctcaaaaggcctgggcattctgttttcttagtacgttactctagtgaacagccacaggtcctttggggaaatatttattgcataatactcgtggtacagttggaaggtcttcaaagaaacccagactccccttaacttgatggattccagatctcagaactggctcagatctggaaagcagcagcaggattgcaatttcccattgtaacagccggtatcagccttctcatcaactcttgggattttttgtttatacaaatcaaagccttatcctgttggctgaaagtttttgttaagaacaccaagggttattagtcaatgccacagttctctgtgggtcaagacaccctagtgggctgtgcacagtggctcatgcctataatcccagcactctgggaggctgatgcagaaggatcgcctgagcccaggagcccgagaccagcctgggcaacatagtgagacccagtctctacaaaaataaaaattagctgggcgtggtggcacacatctgtggtcccagctactcaggaagctgagatgggaggactgcttgagcccaggagttggaaactagcctaggcaatataatgagacccctgtctctctgaaaagaaaaaaatcctatacttggcgaggaatgatggcctacagtaaatgaggtagagctgctaaaatgatgagcagagaaagggtgtcagcagactcagcgtgtgttaaaatgaatttcttacacgagatctgagaaccaaacacctatgttatctcggaaggcccaatagcttcccgttcactcagacnataaaggatgaagtgaggggagcaccgggattgttcagtgacagctgcctcagcaggttacagtagtagtagcggcagc

SEQ ID NO: 259661 - DNA, 251 bp, Homo sapiens
tctccacagatgtcttttctggagaaaataatacgctcgttcctctaattagcccatcggtttcaggttcatcactctgctatcttctcctggagtttacacaagcccttcagagtgtaaacaccgatgtggattcaatcccacttccggagagaggatcaaaccaggaatctaatacaactgaaaacggagcctgagccaggtgtatcacgcgatgcactgggctccagcaggattacccctggaatcgg

SEQ ID NO: 259662 - DNA, 1582 bp, Homo sapiens
cacagacaagtgcaagtgtcaataaaactgggctgggggtaggggtggaactgaagtaggaggagtaaacataatagtgaaagtgtcaacctcctgtagtgatgccaaatgccggccctacagtcagaccctcgggagggccgcccccatcactagtcgtgcgacacaagtgatgtggcatttccaagcctgtgtccccatctgtaaagtggggacagccaccatattgacttccgagggttggtgcaaggattgaagtagccagtccaccaagcatggctctcaggatggagcctggcaaacagcaagcgcccattccacagccacagggatccaggctggcaccgtgcaccgaggcacgcatgcaaagcctctccctcagagcttctctctcaacacggccccacagagcagaccaccagcagcaccgctgtggcgcgggccgggtgggggagaaaccaatcagaggctgctcgaaaaaggtacaaagtcagcacttaggagcaacaggtgacagcgagggaacacacagaagcaacactgacaggacatggccacgtgggaaccaacaacccaatctcaacaatctctgaagacgacaccatcagaaagtaaagcatacggccaccatgatggttccttcccctcaagaaaatgcacttttatttttatctttgagataggggctcgctctgttgcccaggctggagtgcagtggcacaaccacagctcagtgccatctcccacctcagcctcctgagcagctgcgactacaggcgtgtaccacagcgcccggctaattgtttttattttttgtacagatgggggtctccctatgttgcccaggctggtcttgcactactggccttaagagatcctcccaactcagcctcccaaaagtggtgagtgggattacaggcatgaaccactgcacccagtgtaagaaaaaatttaaatgatgtgacactcgtaatgttagaaacagtgagctgcaacagcttcaggggcagaggctgcagccagcaccctctccattgcaggcatagatgcaatctaactccactgatgccacatccaagaggatggcagatgagacattccctgaggttatctttatctacaggacttttttttttttttggagatggagtttcgctctttttccccaggctggagtgcaacggtacgatctcagctcactgcaacctccgcctcctgggttcaagcgattctcctgtctcagcctcctgagtagctgggataacaggcaggcgccaccacacccagctaatttttgtattattaccagagacagggttccaccatgttggccaggctggtctcaaactcctgaccttaggtgatccacctgccttggcctcccaaagtgctgggattacaggcgtgagccaccgtgcccggcccatcttcaggacttttgacgttaagtacataatacacacaatattgttattgtgaatatttggccaggaatatgcttaaatactggggttttcttagagaagctggctaaatgtctaatcacaataactaaactgcgttatcatgaccattttggttc

SEQ ID NO: 259663 - DNA, 408 bp, Homo sapiens
acagtgatcttccctttttgcccacaacaagcagaaacgaggccagtgtgtttaaatcagtgtttattgaagtctcagggattacgcaaagtaaatacatctggagagcaacatgaatcctgataattcttaagatacagctcactctctgaagatcacaaggcccatctcatccttgtgggccctcggaaagaagtgagaacactctatattttccatccatggtgccacatttctttcacttggtagaagccatccctaaatctcaccaccccagagtcacagcattccgtgtgaataatttgtgttctggatttgttttattcctagctgtcctttgtccccgagaaccctgagatatttgtaaagatttgaagtaataaaacaatcttaaagaaggtttaaaaa

SEQ ID NO: 259664 - DNA, 514 bp, Homo sapiens
ctaaaagagtataattgcattgtttgtaacaaaaaggataaatacttgaggtgatggatacttcatttaccctgacgtaattattacacattgtatgcccgtatcaaagatcccatatgccttataaatatatatacctactatgtacccacagaattttttaaatgaataaaaattagagttaaaaggctcttaggtgcatacattataaaagctttatcaagggaaattttgtagtaaatagcaaaaaccttaaaagtttgtgtaccatttgatcaaacaattccatttctggaactgtattttatggaaatatttagggacatgtgtaaaaagttattaagaatgatttcatcaatgttaaaatgtttaacataaaaaatcggaaatgattgggaatatttatgtacgttatgccccaactctgtgattaaatattatgcatgttttaaagaaatatttagcaatatagcaaaatgttataacgaaaaataaatttataaaatcgatggac

SEQ ID NO: 259665 - DNA, 1137 bp, Homo sapiens
  misc_feature (1135)..(1136): n is a, c, g, or t
gagtttcactcttgttgcccaggctggagtgcaatggcacgatctcggctcactgcaacctccacctcccaggctcaagcaattctcctgtttcaacctcccaagtagctgggattacaggtgcccaccaccacgcctggccaatttttgtatttttaatagagacgggtttcaccatgttggccaggctggtctcaaactcctgacctcaagtgatccacccacctcggcctcccaaagtgctaggactacaggcatgagccaccacacccggcctagtatttttttttttaagagatggggtcttaccatgttaccaaggttggtctcaaactcctgagctcaagcgatccacctgcctcagcctcccaaagtgctgagattacaggcccgagccaccatgccggcccaacataacttttatatgcactgcaaaacaaaaaaatccctgtgactcactttattatgatattggctttattgtagtggtctggaacccaacccacagtatcttccaagtttgcctgtacattttagctatctattattaaacaacttagtggcttaaaactacaataattttatttatttgcttgtaattttgcaatgtgggctcaaatagcctttctttgctccacacgcagtcacctgaggtggctccagtgggctggagaatccactttttaaatggccttcttcacgtggctggcaaaagttggtgttgactgctggctgggagttcaactgaggctgttggcccaaacctcagttcttcttcacatggttggttgggcttttcacaggcagtaagtctgagaagtcaaacttctaacacagcagctggcttcccccgaatgcaaaaacagaagctatcaggccttcttaaggcatagtcccaaactggcataacatcacttccaacgcattctactattgattaaagcaagttacaggcccaatcagactcaagagaagagaactcctaaaggtgcaaatattgggaagcctggttcatttggggccaccaaagtagcagtgtactgtaagatagtcaccctgccaagtgttctgtagctgtatatttgtaattacttctaattgtattgagttttaaaagtaatctctaaaaaaaaanna

SEQ ID NO: 259666 - DNA, 922 bp, Homo sapiens
gagtttcactcttgttgcccaggctggagtgcaatggcacgatctcggctcactgcaacctccacctcccaggctcaagcaattctcctgtttcaacctcccaagtagctgggattacaggtgcccaccaccacgcctggccaatttttgtatttttaatagagacgggtttcaccatgttggccaggctggtctcaaactcctgacctcaagtgatccacccacctcggcctcccaaagtgctaggactacaggcatgagccaccacacccggcctagtatttttttttttaagagatggggtcttaccatgttaccaaggttggtctcaaactcctgagctcaagcgatccacctgcctcagcctcccaaagtgctgagattacaggcccgagccaccatgccggcccaacataacttttatatgcactgcaaaacaaaaaaatccctgtgactcactttattatgatattggctttattgtagtggtctggaacccaacccacagtatcttccaagtttgcctgtacattttagctatctattattaaacaacttagtggcttaaaactacaataattttatttatttgcttgtaattttgcaatgtgggctcaaatagcctttctttgctccacacgcagtcacctgaggtggctccagtgggctggagaatccactttttaaatggccttcttcacgtggctggcaaaagttggtgttgactgctggctgggagttcaactgaggctgttggcccaaacctcagttcttcttcacatggttggttgggcttttcacaggcagtaagtctgagaagtcaaacttctaacacagcagccaggtttacgccatcactaacgatgatagcttacgatgatagctaacccagctcttcaacttcctttcaatctccagaaaa

SEQ ID NO: 259667 - DNA, 256 bp, Homo sapiens
tttttccattcatcttcaagcacaactcatcttgtcacaggtcagttataaacagttgacacaccaacctgtccgcaggtttcacgctgaggagcactccctcccttccaacatgaaatggaggctcaacactttcatagcctcacctcctactatgcttctctattctgaagccttctactaagacctgtagatcttcttccatttgaggtaaactctcctttatcctccacctttttctctcatcttctctctt

SEQ ID NO: 259668 - DNA, 503 bp, Homo sapiens
cgatgttggtatcttcataggaattgcattgaatctgtagattgctttgggtagtgtggtcactttcacaatattgattcttccaatccatgatcatgggatgtatttccgttggtttgtgtcatatacaatttctttcagcagtgtttgctaggtctccttgtagagatatttcacctcttggtcaagttatttctagttattttattttactttttgcagctattgtaaaagagctcgggttcttgatttgattctcagcttggtcattgttggtgtatagtggtgctactgatttgtgtacattgattttgtaacctgagacttcactgaattcatttatcagcaattcattcatttttagaggatacttggtccatgcacatgtcagagattgttgtaatgtttctttcttgcaatgatctcatcacattttaatcacaaagtcaggctagtcttttaaataaagttgcaaagcattaatcattttttctcttctctgg

SEQ ID NO: 259669 - DNA, 512 bp, Homo sapiens
agatcaaatgtgccagttactcaggaagtgaaatacagaggtgccaagactcttgccctctgctactgaaagagcagccactgattgctatgtgtgatacaaaagaaatttaagaactcaagagagcacttctgacacagcttattattgccatacatgacatcataattcaacaagtcattatataggggtttcagataacacttattttgtatatctgtcttaaacacatttctaacatcacaaaacataaatcaggaagatatctgctgctgctgctatcaacagatgctgacctgtaccataatgatactcaataaattggttctaatttctttagattattaattccatagataattattctgcatatgtcaaccaagattatgatttcctattactgtttcctttctggacagcctcaatgagctttaataatagcagttcattttaagccagttaggtctgacaaaacttggcaagatatattgcaattgagagttattcataat

SEQ ID NO: 259670 - DNA, 392 bp, Homo sapiens
  misc_feature (1)..(2): n is a, c, g, or t
  misc_feature (13)..(13): n is a, c, g, or t
  misc_feature (29)..(29): n is a, c, g, or t
  misc_feature (170)..(170): n is a, c, g, or t
  misc_feature (304)..(304): n is a, c, g, or t
  misc_feature (379)..(379): n is a, c, g, or t
  misc_feature (384)..(385): n is a, c, g, or t
nnttctcgtcttncacccatcctaattanacccatccttcaggactaagctccaaacaattctactttttctgaatcaggaccaagggaaatttagaatgtagcaattactctattgttatttaatttttaattgcttaagtcttatctgcccaacaagattatcaactncttcaagtcagacttgtcgtacacagatctatacaaataataaatactaaaagtatttaatttgaaaaaagaaaaagcttattcaaaggtggtaaccactccattttccactaagctccagaaagggaagattncaaataataatttaagacatgagaaaagggtcactataacttcatttttccaacaagggaagggacttatgcggnagtcnngagaatt

SEQ ID NO: 259671 - DNA, 191 bp, Homo sapiens
gttagtgatgtgtcatattgaaaacacttttttctctatatttttataataatttttagttggcttactttcccatcaaattccaagtaaatcccagttctgtggtctatgtgcttgctaactccttatcataagctcatgggttcacttgaagtatgtggaaagttgattttaatcagccttcctaataa

SEQ ID NO: 259672 - DNA, 285 bp, Homo sapiens
actgaagctgctgctgggacagaacatcctgagccaccaacgtacagagttttgcctgctgtgaagctcagctctggtgtctttttccccaagtgttgaagtgtcctggaattctcatgtataaacagaggattaaagaatgcaagtttcttagctatttaggaggctgaagcagaaggatcacttcagtctaggagttcgaggttaccgtgagctatgattgcaccactgcactccagactgggtgacacagcaagaccctgtctcttgagaaaagaaaaaaat

SEQ ID NO: 259673 - DNA, 2616 bp, Homo sapiens
ccaattctctgtattgtttattttcacactgctaaaagatatcacctgagactgggtaatttataaacaaaagaggtctaaatgactcacagttcctcatggctggggaggcctcaggaaacttacaattatggtggaaggtgaaggggaagcaggtaccttcttcacaaggcagcaggagagagagagagcatgtgcgcaggggtaaccaccacttttaaaccatcagatctcatgagaacaccctcactatcatgagaacataatgggggaaaacacctcgtgatccaatcatctcccaacaggtccctcctttgacacctggggattgcaattcgagatgagatttgggtggaagttcaggaacaaatcatatcaccagacaaataaaagctgtgggatttcaacaccattaaacctgccttacaaaaaatgctaaagggaattctcaagtttaaacaaaaggacactaactaacatgaaaacaaatgaaagaataaaactctattaaaggtattcttatacagtcaaatacagaatactccaatactgttattgtgcaacagtcacttttaactctagtataaaagttaaaaaacaaaagtattaacaaataactataactacaacaatttgctaatgaatacacaacatacaaaagatataaactatggcatgaataataaaatgtgggaggaggagaagttaaaatacagtatttttaaatgcagtcaaagttgttaccagattaaaatggatggttataactatgaaatattttatgtaaacctcatgataaccacaaagaaaaagtctgtagtagatatacaaaacataaagagaaaggaaccaaagcaaattgctccaaaaaagttattaagtcacaaaggaagacagtgagacaaaaagaagcaacaaaggaactacaaaacaatcagaaaacaattaacaacatgatagtagtaagcctttacctaccaataattactttagatgtaaatgtattaaattatccaatcaaaagagagagtggatgagtgaataaaaaacaagatctaactatatgctgcctgtaagagactaactttagctttaaggacagacataagctggaagtgaagggatgaaaaagagattgcattcacatgataaccaaacgaaagcagaggtggctatccttataacagatgagatagagtttaagtcaaatactgtcacaagagacagagaaggtcattatataatggtaaaagggtgaattcattaagaggatataacaattgtaaatacacatgtacccaaaatcagtgcatctaaatctataaagcaaatattaacataactaaaggagaaataaatagcaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 259674 - DNA, 255 bp, Homo sapiens
agcagccagggctggtggggttggagagggtggtgtcgtgttatttcatcttctgtgtatttatgggagttgagatttttcatggagcaagatggggttacaaatcattgtgtttgttgtttccaccctgatgttctccttcctggagctcctctaccctgtgaagtggtcaggtgccaccagctcttcttagactcttggattctaaatgtggagagggcggtcctcaccccaggcacacaggctctttctctt

SEQ ID NO: 259675 - DNA, 222 bp, Homo sapiens
gaatgaagagacatactaagtgcctagagccatgaatgaaaatacaccacactgaggataaagtaaaaattctataaactttcagaaagaaaaacattacatcagaggatcagaaatcagatggtttcatccttctaaatggcaacgatatatgctggaagaaggacaatggaaaagtgccttcaagattctgaagaataatgatttctaacctggcatggg

SEQ ID NO: 259676 - DNA, 422 bp, Homo sapiens
gccctgctagacaatttcctatgcatggacacatgctcaggtctatcccatcttgaaaccaatgcctgccctggctccccttagtgcccccttccgagcaaaaacttaggagcagtctacattcaccatctcccaattcagtacacccagcatccactaccatcatccccatcctcacagaaaatacaatttactcccgtgtcagtgaatccagtaaatgcacttcagtcttagagtctcacgaaaatgtggtgtctattttctttgagaatcattctctattctcggctcctctacaactgtctcctggttctttccctgcttctctggatcatctggaccatccagaggtcctctttcaccactaaaggctgattctgctcaagagccattctttacccattccttcgcatgcctcatgc

SEQ ID NO: 259677 - DNA, 345 bp, Homo sapiens
tcccttcttctgaatcccataatgccccacttatcactaggctgacactttttactttcagtctcataacatcattacctccacataggcttgtgtgcttccagatcctggcatacagtaaatgtgtgttggatttaatggacgaaatgcttttatctggatacttggcattcttcagtttcgtgtaatttcacacttttagtttgagtggctacgatgtgtgaagctccatgattgggctttgggatgcagctgtgtgagcagacactctgggctccatagtttatcagttgctaggctccaagcagaggtaataattgctcagaaagaccaggagtgtgaaaa

SEQ ID NO: 259678 - DNA, 436 bp, Homo sapiens
taaggcaggagtcttcttggcatgggtctgtcaacctcttctctcccccgggtctgtgcttccaaatgctggtgctgtttgcacacttgtgtctttggccttcactggttctgcttagaatctcccttccatgggtatctacctgaccatctgctcctcttctttcctgtctgaaaaaaaaaagaaaaaaagaaattaaaaagcaaatatatatagagaaaaacttttaatggtaaaatgttcatttttaaaatctagatgcagggcagaaaagtcttgtcatgtttaaactcctctgggtttgaagtttctggaaatgaaaggtgtgggaacaggtctctggagcagcagtgtggaagacggggtactggggctgaagtgagccgagatcgcgccactgccctccagctgacatgagagaacaaggccctgtctg

SEQ ID NO: 259679 - DNA, 122 bp, Homo sapiens
aactgcatctgctgtgcaccatggactcaccagtaaccagtccagtgtgatgtgcatttgaagttagttgtgtagagacaggaaaatctacaagatgttgctatagtggtttgcattattgg

SEQ ID NO: 259680 - DNA, 156 bp, Homo sapiens
cacagaaacgaaaagtttttaaataaaacatgtcatccaaaattgtaaagtgagaaagattgttttcatctcatgtctttgaattgtattgtgagaggtattggtcttcttccaccaatccaaagttaaggacaaataaatttcattgtatcggaa

SEQ ID NO: 259681 - DNA, 413 bp, Homo sapiens
taatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagaga

SEQ ID NO: 259682 - DNA, 247 bp, Homo sapiens
gtatcttcttaaaaggatgaggaagctctgtttacctaaatgaaaagctttctaggaggaagtcctaagtgaacaatgatgcatgaggatgcaatcttacaggcaaggagcccagtgataacaaatggctgtagatgcttttcctccatcaagcttccaggaggagatgagatggagcccatcgctgagccaaggtcaccagccccatttcacaaatgtaaatagcaggtgtcccccacacagtctg

SEQ ID NO: 259683 - DNA, 805 bp, Homo sapiens
ggatcctgttgatctatgaccttaaccccaaccctgtgctctctgaaacatgtgctgtgtccactcagggttaaatggattaagggcggtgcaagatgtgctttgttaaacagatgcttgaaggcagcatgctcgttgagagtcatcaccactccccaatctcaagtacccagggacacaaacactctgcctaggaaaaccagagacctttgttcacttgtttgtttgctgaccttccctccgctgttgtcctatgaccctgccaaatccccctctgcgagaaacacccaagaatgatcaataaaaaataaataaataaaaataaaagaatgatgcacattttaataaaaaaaaatcaacaacaaactggaaaatatagaggcacagtttttgtattcaattgaagttgtcatgagattaaaatatattgctttaactgtaagatgtatgtaatctacagttttcaagatgattgcaaagattctgtttaaagaaagtatctaaaataaaacaaaaaataatcaaagcatgccagtacaaaattaaagagagtaaaaaaggaaatgagaaaaatatactactagaaacacatgaaacaataacaatatatctggaaataacaacttcatttctttaaggaatcattttaaatttaaacgtattaaactacttaataaaatgaaatataatctcaggactttggaaggccaagataggctgatcacttgatcccaggagttcaagaccagaatcggcaacatggcaataatctgtctcgacaaagaatacaaaaaaaaaagttggc

SEQ ID NO: 259684 - DNA, 353 bp, Homo sapiens
atgcttgatgccacggcctatatacaattatcatatccccttaattggaaaagtttgaacaatcaaagggcatttttctaaatggcctcctcaactgttttctgtgttttggtcatatccaaacatattttgatattttgtatgtttgtcttcaggcttactcattaaacctctacctgacttctttattggagactttcgcaagctgctctgaaaattcctttttgattcccttagatgagccctgaaatgtctctttggatcttctggactccacaaatcacaattttaaaacaattagactcataatgctactgatataagagtctctgaatctaacagtaacatcaagg

SEQ ID NO: 259685 - DNA, 1359 bp, Homo sapiens
agggttctaaaaatcattgtgccagagaatttaaatcttcatatcatggtaagcacatgcgtatgtctgtgactcagtttcttagccagacttccaggtgttagttaattccttctcatttagttctactgtaatccattctgggaaaatgcataccacaaaactgtgtatcttgcagcttctttcgttatgcatcttaattccctcagaaggtcccagaactttatgttaaagatctgggtttttaaagacaatttgggggccttctaaagaaacaatagtagatctaattacaagtagtggattgcttacttcaaatttctcttttacaatttagaaagtttagtaccagtttatagactgagggagtagtagctactatttagatgctgagaataatattatcatgcttgggtggggaagaaaggcccttactcaaatctccattttcatttttaatgcttcctggacttcagttattttcttgcttttgcctcaagaataataaatatttttggttaaaattttttttgttcaaccctgttgttgttactgttattttcatagcacagtagtctacagctctctatagtagcttaatagctatttgctgaatgaatggaacatggagtgttacatctgaaactattctattagaaggtgaaaagtgttgattgaagaatggtaggattttatcttccctacccatgatagatttattaagattgtctttggagctatgtcttccattccaactatacagaaataaacttttttaaagtttagtttgcccatctgataaaggaacattcctgtatgctattctaaggttcattttcaacaaaagttacagacatttatggttgatagtttgagatctatgacagttttagggagctccatattcaaaaggctattgctggtgatagtacaatgaaacactgacttcagtatatttttatcttggctttcattttacggttatttctactactgttaatatggactaatacttgattttgtgaacctgttttaattttagggttatatttatgttggaataatatattttaaaagtgtcctatactatgaatttatttgccatatataagacaatcagaattatctggtagtttattctaatcctggttaataatcattaggactaaactatttacattaaagaaggaaaaaacaatgagatgataattttttttttctttgagacggagtcttgctctgtcggccaggctggagtgcaatggcgcgatctcggctcactgcaacttccgcttcctgggttcaagcaattctcctgcctcagcctttccagtagctgggactacgggcgccctccac

SEQ ID NO: 259686 - DNA, 294 bp, Homo sapiens
ttttttttcccctaagtaacattgtccttagccatgatccttatttgctaaacaaaatcacaactttataggtaagaaaaataaggcctagagtggttacatgacaaagttcacattctaagagttaagaccacaacttgaacactgcctatgtgaagactcactgccaagaagcaaacctgcaaagccagtcatttaacccataactcctgtaagcctgagactcaaaggcaaaccaagcctactgtgagtgactttaaacttgctgacctacaatcccctataaattcataa

SEQ ID NO: 259687 - DNA, 261 bp, Homo sapiens
ttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacagcctactgaagatgaaccatctctttcatgtctacccatctcccagttgcatagtacagtgtctgacaggtcttaggaacagcaaggagctcagtgt

SEQ ID NO: 259688 - DNA, 503 bp, Homo sapiens
ctgagtattaggatccgcatttcctggtggtgtattaagccagaaggccagctcaaaggcttcatttgtaactttcatttttaggtcaccctggcttatgaacattagtacattgctttttgggaaaaggacacctaaataggaagcttttatcaaaaaacttaaaagcacatttttctcatcctccattcacactgagaacaactaggagtagtacgtcaggtcctctctctgtgggtccggggaagcccattgatgagcagcttttggcttggcttgctcatttcaggtcagtcgatcaagcagccttaaaatatccactggtgttcaaggagtcatttgatcctcactcccttcctgttcttctctctggaaagctcagaactacctgtcctacttttcttcaattcagaggctctcttcccagaaagctgcagtctacttactggatttcatgaacagacacttctcaaaagacgacacacaagcagccaataaacata

SEQ ID NO: 259689 - DNA, 366 bp, Homo sapiens
gaagttgacatttatattataagaggggagtttaagtatatctgctatttgttatgattagtgtgcttgagtttctctacttaccaggtcactttttcaaacatacttctataagatgagctgcaaagctagaactgggataagaaaaatagagagtacaaagcgatcctctgtcagaccccacctctcctatcagtcccaatttgctatttgccactcatatccccagtgcgcttatttcccagttaagtgttactggtaagaactttctgaatttagggacatatgtatcagcatttgacatctaactttaatttagttcaaatattatcaatgatggcagtggcaggccatccggagcggccg

SEQ ID NO: 259690 - DNA, 478 bp, Homo sapiens
catcttaaatttttaaaaatgctacagtttgtgtattgttgataatacagatgatatgtaagcatggtaatatgtgaatggcctttataaattaacagatacatctattggggagggttttaaaatcatttattgatggggtgatgatcagaagagtttggagaccaagtaactgccagcataaagtccaaaccccttagcttgaccagcaaggtcctgtctaaccctgtcttcctgcctacatccccagcctcatggacctccagatgtcttatacctgctctaaacatactaaggactttagtcattctgacatctgcgccaatgactcttatatctgcactgcctcgcccttcctaacccgaacctcttctctgcctggcccaaagagcacatcctttgagagtctttccgtttctcccttaccaccactccatctgcatcttttttttttctcttttgagatgagtttcactct

SEQ ID NO: 259691 - DNA, 412 bp, Homo sapiens
aaatcctgttctcctatttgtttgcaagttttctctctagtgaaaaatacttcatcattttgtccttggggaattcattaaacagaatgtggaaaaatgtaatctttagggagttttgctgtgagtactctcagtaaatacagcacaagccaagagactctacagagacctgacctagagtagacgaagcctgggccattgtcagataatcatttccttgagctttgaggcagtcacttaattgttttgtcacctctgatttttgtaatattgggcctaattgcatctccctgatttgtggggagtgtttataaaatatgtacaataattattatcattaataaactggattattaatcccctccaaaaataatgtgccaacatgtcaataaaatttacaccttatccttta

SEQ ID NO: 259692 - DNA, 644 bp, Homo sapiens
tgcccaggccgagatgtgaaccctgagtttgtgcaactcgagtttcagagtggcggcctctgctcctcacaagacattgccctgcgagggggtcagccctgaagccggatggcccggcccccgctaccacgtggaggctccctgtaggtgcttgtgtagatgcccccgtgcggggacttgtttggctgatggatcagggggaaggttctccccacggtgtgaggcagcaccgagggctccgtgcccagcaggctcactgtcggcagttgggtctggtttgataaccgtggaccggggtgacaggccctgactctgcagagcaggactgtggaaaatggacactgatgctgcccggtggatccaggcagggccgggatgtttgcaggacccacgggacaattagaacgactgggcctgactggcacagggatgtggactacggtgcttgccatcagcagatacaagctgtacgcagtgggccgcaggcgctccctgggccggaacacatggacgtccaggtgtggaatggcccggacagcagataacaagccttcgtcgtggtcacccctgggtgtgggctgtgggttttaatcttttcatttttgctcatctgaattttctaattaaaaatatattgcttttta

SEQ ID NO: 259693 - DNA, 662 bp, Homo sapiens
gttacatatcacaaaaacatgcgttgtgaagaccagccaagcatacaacaaatcagtcccattcagtttgggattacaagccggacgaacaatagagcaggcttcaaaataaacttccgtttccaggatgagaaggaaacatagggacataagctcttaggagacacctgcagtgagcagggacctgcgccagagaaagggtataaagcggagcctgaaaagaggggactccgaggaagacaccgcattcattcttccatcccacaaactttcgccaagtgagtcctttgtgcccggctttgtgcttggctttgtgctacgcagcaggcacaggctgatgaatcagttagaggcgcctgcccccttgggcctcacaatctgatagaagggacaaacaagtaaatatagaacctgcattcctctcattcaagtgaaaaggacatcctgattaaaatatctatggcagctctgagaacattcgtgcccaatcacagtaagggcctgaactgattgtcatttcctttgtttaaccaattctcttacacctggagtagaatccctggggccagcccggctgggtacccaacgtgatccctccagatctctggagcagctcgccttcctcataatcattttaccctgggatgtttcagcctttgagg

SEQ ID NO: 259694 - DNA, 241 bp, Homo sapiens
aattcttattgagggagttttctcagaagcttgaaagatgcaaatgtagggcttgaaaaggaaggactttctaccctgaacattaaacttaggaaatgcatggcctgaaaaagtacaacaagaagaaaatacaaagtgaagtctaccacctctggaaataatagagaataagaagaaataaaaacagctagtatcttcatagccctcctacatttgttttttcactgattcctcgtcgacg

SEQ ID NO: 259695 - DNA, 563 bp, Homo sapiens
cgtcggtggtgtgcacaggaacacgagttgctctaagttgaaattcttggaaacataccatgtggctgcaaatagaggagccctgggagacagcagggaggtggcagggtttctcgtggactgcctgtgcctcgttccagagtctgattcccagatttgtaggctaagaaatgtgattcatcatcatgttagtcaggctctgattcactcatcttaagcatgagtgttccaggttagccatcaggagactgaggcatgggggttggagctgcccatagtcagtcagcctcccaagaagtggggggctggaaggtccaacctcagtggcttgactgctctgcagcccagagtaggcaatgagactttccttgttaatggggtgaggagaaaatggaagatttcgagaatttctcactactccatgcagtaagcaaaggaggggcagaaaagggactacttttactcttcgggaactttagaccttttaatcgcttcaaatatagtggcattgaaatgcaaagtattttcaaattgcattgtaatcttcatctctttcagaaatt

SEQ ID NO: 259696 - DNA, 549 bp, Homo sapiens
agctacaggtagtcagatttcaccttgagaaggaggaagggcttttgaataatccaagttgttaaggtagaattgcctccctcaggaggaatgagattccttatcagtgaccagaaaaaggatggtcagatatttctcagacttattaataagaattttaaacataggaataatggttcagactaagagggttttaattttgatattctattgtgattcattcaacaaataatttttgggatacatagtacttgctagatactgttccaaactgtaggaatgtagcagtaaacaatctataaggtcctgctctcattgtagtttacagtgtagtaaggagaaataatgagcaacttaactttctgtaaagaaaatatagtgaaagtgaggtgagagcaagtgactggggaagctacctttactttagatggtctttgaatgaggatgaggagggactggtagtgagaagattcagagaaagggcatttcagacagaaggaataactagcattaaaaattcaaaagcagacctgggcttgaaatactcag

SEQ ID NO: 259697 - DNA, 682 bp, Homo sapiens
ctaaatactgagctgggatggaatctctgtgctggaggctagtggtgcaaacattttttccgcatgaggttcagaaaggttaggcggcggtttctcatctgcaggcacaggtgactgactgccttcagcatgggcccatctgtccatctctcctcctgaccctggtctcattacaggagagggaactgggtgctagagggtggggaatccaggatgtcagaggtgtcacacctggataaagcgttttgaaaacacaagtcccagggctgattattgattttaccacatgcagcctgtttttatttatgaagtttcttttcttttcccttaacttccaatgatacactataatgtacatcaatgtccttaaaatgtatgtagtcctcttcatctagtgactatactgatcctcaagtatccattctctagtcaagggttatacctgtttctcctaccccacggcagtgctgggtctggtgtacccctcccgcagtatcgcctccccctaaataagcacgtttccctataatttcttactttttctctatgccttcccatcatgtttgcactcactgtgaagtaaggaaacgcttcctaattctgttattccttcctactcttaggagatttctccctctgcgctgaggatctcactgtgcacctccagccctgggtcctggtg

SEQ ID NO: 259698 - DNA, 414 bp, Homo sapiens
gcctgggcaaaaagagtgaaactcggtctcaaaaaaaaactggttcagtcatgggcctggacatttatttctgaaaaaatatttaatttaaaaagaacaagtccttccatttttatttttttcattcttcttataatattcttatattttatttttcattcttcttataagattttacgtgtgacattaaaaaggacaaggaaacagatgcatctttaatctgctattttaaacccaaaggtccaaagcacaattttgatagtactgaaaatgtaagagccttgtctttcacttcctcaatagttttttttagaaaagatgtaatcattactcctatgcaaatataaaatgggcatatatcaaatgctttatttaattcataaaaaatgaattcaaagagaattatttgaatta

SEQ ID NO: 259699 - DNA, 659 bp, Homo sapiens
ctttgcttcagtgtaaagcaatatgcttggcagtcatatcatcactatattttccttcctcttaaaaatacaatgtgctatccatgagcagatcacaaacttggagccaatcaaaacacaccttgtatagtattcattaaccataatttattatgtgtgtgctgatatgccattatgatttttcagctttggtactgaaatatttagctatggttgctgaatataatcagcaagttaagaggttttgaatatgattatttgaagcttttttaacagtgagaaactaggttgaaaagagcattgacagctaaaaacaatggagctttttctgtactcaatactataggtaatggtatatttttctaagtatttataatttattctaaggataagtacatatctgatgactgaaacatcatttgtaataggtacattatttaacttctcaagacatgtgttactatcttggctgagggattctgggtaaattttaaacaataaattgaaattctattgtttctagtgtgtagttttaaagattatgatctcaacattcaaatttaggtttctcttttctttataaaatgactgcattagattcatagacagaaatttaaatgatgcatttgtactttcaggagctactatgtatttggcat

SEQ ID NO: 259700 - DNA, 1973 bp, Homo sapiens
atgggaaacagggtgaagcagagaagcaggacccggcagtggcaagcactcttccctttcctgctgcctttgttctgcggggcaccctcggagcagatccgctactctattccagaagaaacggtccagggctccgtggtggggaaccttgcggaggacatgcggctgcatgttcaggatttattgacctgaaaccttagagttagtgcagagaaacaatactttaccgtgaacacggagaatgggaacatacttgtgagtgacagaatagatcgagagtcactgtcttcaaaatcctctgtgtcatacccttagagattgtagcagagaatcctctaaatgtttttcacataaatgtgatgatagaagatataaatgataacccacctcattttccccaaaatagcattgttttacaaatcaatgaactagcaattccaggcattcggtttggcctggaatctgctatagatgcagatgtagggcctcactctctccagagttaccagctcagttctaatgaacatttctctctgatgatggacaagactaaaggcaagaacgctccagaattagtgctggagaagcccctgggccaggagcaacagagctctcatctcctggtcctggaagcaatggacatgggtgacccagtcccaactggcactgctgcaattcaaattgaggtcactgatgccaacgataatgccccagtttttagccaggatgtatacaaagtcagccttagagagaatgtgcccccaggcacctctgtactaaaggtgacagccactgaccaggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgtaaaattatactagaaatcctagatgagaatgacaatgccccagacgtggtttttacttcagtgtccagttctgtaactgaggacgcagaaccctggacggtgatcactctgttcaaaacacatgataaagattcgagagaaaatggggaggttacatgcctcataaacgaaagagttccttttagaatcgaatcttccgccaataatgactataagcttgtaacagatgggaccctggattgggagcggatcccggagtacaacgtcaccatcactgccactgacaagggcaagcctccgctctcatccagcacaagcctcaccctacgcattggtgaagtcaacgacaatgctccggttttccaccaagtctcctacgtggtccacgtggccgaaaacaaccttcccggagcctccatcccacaagtcagcgcctctgacctggacctagggctgaatggccaagtctcctactccatcgttaccactgacttggagctgcgggcactgtcgtcctacgtgtccgtgagcgcacagagcggggtggtggtcgcgcagcgtgccttcgaccacgagcagctgtgcgccttcgagctcacgatgcaggcccacgaccagggctcgcccgcgctcagcgccaacatgagccggcgcatgttggtgggcgacctcaatgacaatgtgccgcgggtgctgtaccccgcgctggggcccgatggctccgcactcttcgatatagtgccacgcgccgcagagtccggctacctggtgaccaaggtggtggcggtggacgcagattcgggacacaacgcttggctgtcctaccacgtgctgcaggccatcgagcccgggcttttcagcctggggctgcacacgggaacctgctggttgctgtgcgtgacggaggacagccgccgctctctgcgccgctacgcttcacctagtcttcgcagacagcctgcaggaggcactgccagacttcagtga

SEQ ID NO: 259701 - DNA, 2061 bp, Homo sapiens
aagcttgatatcgaattcgcggccgcgtcgacgggaggcgccaggatcagtcggggcacccgcagcgcaggctgccacccacctgggcgacctccgcggcggcggcggcggcggctgggtagagtcagggccgggggcgcacgccggaacacctgggccgccgggcaccgagcgtcggggggctgcgcggcgcgaccctggagagggcgcagccgatgcgggcggcggcggcggcggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtgatgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgtggctcgattcccgggattcattcctcagcctctgcttctcccttttatcccaataagttattgctactgctgtgaggccataggtactagacaaccaatacatgcagggttgggttttctaatttttttaactttttaattaaatcaaagaaaacaataactggtttggaccaggtggtttctttgtcagctggttcccaagaggtggggggagagggaggtttagaatggagcttcaaaaagaagcccttatcttaacccatggcctggccacatagacctccttgga

SEQ ID NO: 259702 - DNA, 1000 bp, Homo sapiens
tatggaaaagaatcttccttccaatccagaaggagatggagagaatctatctgtagcggtttccttctttgataagtcaagtctgactttgaagtttaaacatgatgaagttctctgcttttcaagtggaagaaaacagaacagggttggcaaatactttactgaaaacaaaaggctcaagaatatcagcactaagaaaaaacacatgaagagttttttttaaagcagatgactttaacatgattattctcctgattactttataataatggcattacagagaaacctttaaaagatgaactattttaggatagataggcaatatcctactaaactaacttggtaattcactaatgactactccaaaagtagaaaaattaattgtgtatcatggatgtattcctctctctctctcttacacacacacacgcacacacacacatacacttactcgaaagtatttttgctgctttattcaacaaaacatatcacaaaatgtgagaaaaagaaaattcagatatatttatttctattccagatttcaaagtgcatagaaatttcaggctgagaaaccgttttttcagctttcactcttactagcaaatctaaaggcttttataaaacatgagaacaaagtgcagtttgaaacaccaaggttttcattactgtttcttaagtttttcaaaaagaacaagggtgggaaggaggtagaagagacagggttcaggcgtggggagggatatggcgccacatttattaatcacattaaaaactaagcatgccaacatctggagctaaacaaccagcaaaatcaccacgttcagactcgtattggctaactctatctatcccagcattctcttgggacagcggtttgccctaggctctaccacaagctcggtgaagtacacagcctcaattactagagcgtgcagccacaacgacctggtattacggaaacagtcagtcaccacttgagttaacattccataccctaacg

SEQ ID NO: 259703 - DNA, 369 bp, Homo sapiens
aggtgatctcccaccaggtcctttttattcccatgtatttacagatgcagatcctctacaggatccttgtcaatcgcactgccgttccaaataattaaaggaggaaaaaagaatgtttattgagggcttactatgtgcctgaagtgttttaagggtttgctcgcgtgaactctgggtggtcggcttcccacgtcgtctcccaccctccgctctgggtccagccttgccctcttgccccacactccccattcttcacaaggcatctggcgaggtcgttaatttttaaaggtaaatcagatcaaatcatgttcccttccgcggcttccaccgtgcctcgaatcaaatcccaattcttagcgaccctatcat

SEQ ID NO: 259704 - DNA, 573 bp, Homo sapiens
ctccaacatggggctttcaatccgctgtgagtccccagcttctgtgcatgcccaatgtccacggcacacagctgtgccagaccctgctgtcgggataactggcaccagccacgggcaatagatgacctcaatctaccagcctgagagctccaccttgatcgccactggtcctcctctttgatctctttctctctttctgctcattgtttctctttttccctccaaatggactttgtccactctggttcccatccttgtgccagcccctccctttcctgtcatcttgactctgtgcagttggctccacactacgctcgttcaggtggcctttgcctgcctcataattctctgctgaaacagagtaataataaaaaacccaagaaaagaaaatatttaccagttctgaaatggcttgaattaatgaaataatgttttggggcatttagattgaacccgtgtaattgtaggttgcaaagtataatagtagctcatgcagggatatcattttgtgctattttactttcaggtttttgttaatccagtgggtttggtggaattagagggctgctgtga

SEQ ID NO: 259705 - DNA, 762 bp, Homo sapiens
cagtagaggcgaggtctcgctgtgttgtccaggctggtcttgaactcctgggctcaagcagtccttgcatcttggccccacaaagtgctgggattacaggcatgagccactgcatcctgccaggaaacactaacatttaacaagttttctaatcttttaaaataaatagacctgactcaggtaactgctacttaaggaagtgtgtgtaatttttttctctatttataaagaggatcccctgttggcactttgatatctgtgcttttaaaatttgatttttctccttttcctctttaccttccttttccttgcacacagttaagtaaaccatcacatatttaatgtgtatattaaagattgctttcattctctgaatgtttttgaatcactctctaaaagttaatttgaagaaaaaagttgaaaaattaagaatgcattaacatatttgtttcttaattcacgtaagattaatatggctgggcacagtggctgacgcctgtaatcccagcactttgggaggctgaggaggatggatcacctgaggtcaggagtttaagaccagcctggccaacatggtgaaaccctgtctctactaaaaatacaaaaaaaattagccggatgtggtggttgcatgcctgtaatcctaggtactctggaggctgaggcaggagaatcgcttgaacccgggaggcggaggtttcagtgagccgagatcttgccattgcactccagcctgggcaacagagcgagacttcgtctcaa

SEQ ID NO: 259706 - DNA, 838 bp, Homo sapiens
atataaggtaatgatgatccatacacttgctcttttagagatgattgaattttattatttttccccaaatcttttccagataactacatttagctctaatgaccacagtgaactactttgaccttaaaacacaagtgggacaataaagccttttggattgttgaataaataaaagtaaaaatgtgttatctaatttctgtgaagcacctctaaagccaatactggccaatgcttcaccagttagtcatgctccaaggattgaggtcatgaccatgggaataaagttatttcaatagttgactcttttgaaaagtttgttactcacatgacttcccagtatcaacagtgtaattcagattttcttatatctaccgtacagactaagtaatgattaggaatttaaatttttaaatatgtaatagaaactggcttgtaaattcttaagtcatatcatataaaattgatagcaaatatttacttatatttctgaaatttatcctcagatgaattctaaaaatttatgccagtaacctgtggatgcctaaagaattggccctgacatttgttaatcaagttaactgcaactattaacattatatcattgtgcattacttggccctctgcccatagcctaccaattcatttttaaatgataaaaccaatgaaaatgttcagtataaatcaattctttatctatatttagtccttactatatattcttttgtaccctaacattagctgcttactcaatattcattagcttataacttttatgtatagaaggcacatgaatttgtttcttctgtaatacacatcacataatgtttaggagagacca

SEQ ID NO: 259707 - DNA, 4452 bp, Homo sapiens
tgaacccgccctctgcgcgtgagcgtgggcgtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaactgcaggggggattcatgttgtgtttcctggatgatggatgtggcatgagccctgaggaagcttcagacatcatttactttggacgatccaaaaaacggctgtcaaccttgaagttcatagggcaatacggcaatggtcttaaaagtgggtccatgagaattggaaaagactttattctttttacgaagaaggaagaaacgatgacctgtgtgtttttttctcagacattctgtgaagaagaaagtcttagtgaggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtactttgctggttatttataacttgaagcttctgcttaatggagaaccagagttggatgttaaaactgacaaagaagatatactgatggctggagctctggaggatttcccagcgaggtggtcattcagagcctacacatctgttctgtattttaacccatggatgagaatattcattcaagccaagagagttaaaactaaacatctttgctattgcctctacagacccagaaagtatctttatgtcacatcttcttttaaaggagcatttaaagatgaagttaaaaaggcagaagaagcagtaaagattgctgaatccatattgaaagaagcacaaatcaaagtaaaccagtgtgacagaacctctttatcttctgccaaggatgtattacagagagctttggaagatgtagaagcaaagcaaaagaatcttaaagagaaacaaagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttacttggcgcaggcgtggttggaattgttaatatacccttggaggtcatggaaccatcccataataaacaggaatttctcaatgtccaagagtataatcatctactaaaagtcatgggacagtacttggtccagtactgtaaggacaccggcatcaataatagaaatttaacattgttttgcaatgaatttggataccagaatgacatcgacgtggagaaacctttaaattctattcaatatcaaagaagacaagccatgggtatcccattcatcatacaatgtgatctttgtcttaaatggagagtcttgccttcctctactaattatcaggaaaaagaattttttgacatttggatttgtgctaataatcccaaccgcttggaaaacagttgtcatcaggtagaatgtctaccttccatcccactgggcaccatgagcacaatatcaccatcaaaaaatgagaaagagaagcaacttagagagtcggtcataaagtatcaaaatagactggcagaacagcagccacagcctcaatttataccagtggacgaaatcactgtcacttccacctgcctaacttcagcacataaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccagagaagtcagattgctaatattaccactgtctggagagctcaaccaactgaagggtgcctgaagaatgcccaggccgcttcttgggaaatgaaaaggaagcagagtctcaactttgtagaggaatgtaaggtattgactgaagatgagaacacgagtgattcagatataatcctggtttcagataaaagcaacactgatgtttcattgaaacaagaaaaaaaggaaattcctcttttaaaccaagaaaaacaggagctgtgcaatgatgttctagcaatgaaaagaagctcttcattacctagctggaaaagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaagggagattcttctgtatttttttcctgagcatcagctaccatcagaattggaagaacctgcattaagttgtgagctggagcagtgcccagagcagatgaacaaaaagctgaaaatgtgtttcaaccagatacagaatacttacatggtccaatatgaaaaaaaaataaagaggaaattgcagtccattatctatgattcaaatacaagaggaatacataatgaaatctctctggggcaatgtgaaaataaaagaaaaatctctgaggataagctgaagaatcttcgtataaaactggcactattgttgcagaaactccaactgggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataagaaataatttttttcaaataagaaaattgtgtactctagaaatggagaccgatttacaatttatgtattccctaatccaattatctaaatcttccttttctttcagaaatattaataatatctagagttctctaattttcatgtgagctactgaaaaaaatgaaaatgtcactcaagcttaacttttgttattccttaaaagattgttattgtaattttgttattccttaaaaacatttaaaagcagattttttcaaaatcgatatgtgaaggactacagaatcacctcctcttgaagatattgaaaaagaaagacattatgccctttctccactatagccaacactcagtcaagcagaaaatacaaatccccccaaaactttgagacatagcttatataattttattatttagtcatagtaaaagaataaatctcctaagcataatatgtatacatattacacatatgtaaaaattgttgttttacatttacatatacgtaaagaagtatgtttttacacttttcttgataagtgtttttttttgtttagaaatgtctgaaactttagacaaaaacaataaaacatttaatattcatttgtgaaactgtataattttaatttatgtatatgcacatagcaaaagcctggaacatgggaaatggaatatggtaaactatttcatttttgtctttagccacttaggtactcttctcaagaggcatgtttttaccagttcctcgtaaatctgtccccaatcaatatctgtaaaaccatatatatcatgatatagctatagatatggatgtaatagcatccaaaagatgctgctgttgcttttttccactcaatataccttcaagatcattccatattgagaccagtacatgtaataatacatatgtatagagagctaatgagataacctctcgttatcttcaactgctccttattattttattcaatggaaatactaaatctgtttaaccatttccttatcaatgcatgtttaggtttttattgttcttttggatttacatatgcacaacatttgaatatccttataaatttgttcatttcacacatgtacaattatgtctgtcaaatgtctcagcaaacaaattgctggatcaaagggtatatacatttattatgaatagatattgcctaatagcactttgaaaaaatttttttagtctacactcctacagcagtgtatgagtttttttcctcacaccttcacctacctggtggattaccagactt

SEQ ID NO: 259708 - DNA, 3783 bp, Homo sapiens
tgaacccgccctctgcgcgtgagcgtgggcgtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaactgcaggggggattcatgttgtgtttcctggatgatggatgtggcatgagccctgaggaagcttcagacatcatttactttggacgatccaaaaaacggctgtcaaccttgaagttcatagggcaatacggcaatggtcttaaaagtgggtccatgagaattggaaaagactttattctttttacgaagaaggaagaaacgatgacctgtgtgtttttttctcagacattctgtgaagaagaaagtcttagtgaggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtactttgctggttatttataacttgaagcttctgcttaatggagaaccagagttggatgttaaaactgacaaagaagatatactgatggctggagctctggaggatttcccagcgaggtggtcattcagagcctacacatctgttctgtattttaacccatggatgagaatattcattcaagccaagagagttaaaactaaacatctttgctattgcctctacagacccagaaagtatctttatgtcacatcttcttttaaaggagcatttaaagatgaagttaaaaaggcagaagaagcagtaaagattgctgaatccatattgaaagaagcacaaatcaaagtaaaccagtgtgacagaacctctttatcttctgccaaggatgtattacagagagctttggaagatgtagaagcaaagcaaaagaatcttaaagagaaacaaagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttacttggcgcaggcgtggttggaattgttaatatacccttggaggtcatggaaccatcccataataaacaggaatttctcaatgtccaagagtataatcatctactaaaagtcatgggacagtacttggtccagtactgtaaggacaccggcatcaataatagaaatttaacattgttttgcaatgaatttggataccagaatgacatcgacgtggagaaacctttaaattctattcaatatcaaagaagacaagccatgggtatcccattcatcatacaatgtgatctttgtcttaaatggagagtcttgccttcctctactaattatcaggaaaaagaattttttgacatttggatttgtgctaataatcccaaccgcttggaaaacagttgtcatcaggtagaatgtctaccttccatcccactgggcaccatgagcacaatatcaccatcaaaaaatgagaaagagaagcaacttagagagtcggtcataaagtatcaaaatagactggcagaacagcagccacagcctcaatttataccagtggacgaaatcactgtcacttccacctgcctaacttcagcacataaggaaaataccaaaacccagaaaatcaggcttttgggcgatgacttgaagcatgaatctctttcatcctttgagctttcagcgagccgtagaggacagaaaagaaacatagaagagacagactctgatgtagagtatatttcagaaacaaaaattatgaaaaagtctatggaggagaaaatgaactctcaacagcagagaattccagtagctctgccagaaaatgtcaaactagctgagagatcccagagaagtcagattgctaatattaccactgtctggagagctcaaccaactgaagggtgcctgaagaatgcccaggccgcttcttgggaaatgaaaaggaagcagagtctcaactttgtagaggaatgtaaggtattgactgaagatgagaacacgagtgattcagatataatcctggtttcagataaaagcaacactgatgtttcattgaaacaagaaaaaaaggaaattcctcttttaaaccaagaaaaacaggagctgtgcaatgatgttctagcaatgaaaagaagctcttcattacctagctggaaaagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaagggagattcttctgtatttttttcctgagcatcagctaccatcagaattggaagaacctgcattaagttgtgagctggagcagtgcccagagcagatgaacaaaaagctgaaaatgtgtttcaaccagatacagaatacttacatggtccaatatgaaaaaaaaataaagaggaaattgcagtccattatctatgattcaaatacaagaggaatacataatgaaatctctctggggcaatgtgaaaataaaagaaaaatctctgaggataagctgaagaatcttcgtataaaactggcactattgttgcagaaactccaactgggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataagaaataatttttttcaaataagaaaattgtgtactctagaaatggagaccgatttacaatttatgtattccctaatccaattatctaaatcttccttttctttcagaaatattaataatatctagagttctctaattttcatgtgagctactgaaaaaaatgaaaatgtcactcaagcttaacttttgttattccttaaaagattgttattgtaattttgttattccttaaaaacatttaaaagcagattttttcaaaatcgatatgtgaaggactacagaatcacctcctcttgaagatattgaaaaagaaagacattatgccctttctccactatagccaacactcagtcaagcagaaaatacaaatccccccaaaactttgagacatagcttatataattttattatttagtcatagtaaaagaataaatctcctaagcataatatgtatacatattacacatatgtaaaaattgttgttttacatttacatatacgtaaagaagtatgtttttacacttttcttgataagtgtttttttttgtttagaaatgtctgaaactttagacaaaaacaataaaacatttaatattc

SEQ ID NO: 259709 - DNA, 333 bp, Homo sapiens
catggtgactcttggagagggaagggcaaattcccataccctgcagtggtaaggggctgggactgagagagtggcagcgagacactacaggtcacaggaggacttggccatcactgtgagacagcaggcacaagaagtgttcaagcagaggaaccacatatttattattattattattttttgagacagtgccttgctttgtcacccagacttgagtgcagtggtaccatcatagctcattgcggcctccaccttgtgggctcaagtgatcctccctcctcagcctcccaagtattggggaccacgggtgtgcaccaccacacctggctaatt

SEQ ID NO: 259710 - DNA, 442 bp, Homo sapiens
tatttcaatgtttatgtcgtatctcttccgtaagcgattggtgggtctgaaatccactttcactgagatacttggttgacgtcaatacaaatgagaacagtgcggaccgttctgcccttcccctgaaaacacaaagtggagctttaaaacaggctctcacactggattttaggtggatttggattttaactccagttgtctatgagcaattaaaaaaaaacccacagcaggacgatttccaaggatattagaggatttaatgaacaaggatcgcatttaagggaagaggggtaacgaggagtaaaacgaaattttcctgctttttcctgtgagaagtatcattgtaattacccatgtatctaaattaaaattgcatattcatgttttgcattttcaattggccttgtataattaaaactgcatcacatttgatgaatttaaa

SEQ ID NO: 259711 - DNA, 608 bp, Homo sapiens
ttagccgggcgtggtggtgtgtgtctgtaatcccagctactcaggaggctgaggcaagacaatcgcttgaacccgggaggcagcagctgcagtgagcagcgattgtgccattgcaccccagcctgagcaagagagagagattccatctcaaaaaacaggaaaccaaatactgcatagctccttcaaaatagtgttttttaaaaaaaaaatgttgggccaggtgcagtggctcggctcacacctgtaataccatgagttgaagaccagcctgggcaatatattaaaaaagccagcgtggtggtgcatgcctggaggcctagctactcgggaggccaacgcgacagggtcacttgagcccaaggcgttttgaagctgcagcgagctacaatcccgccactgcactacagcctgggcgacagagtaagaatctgtctcaaaaaaaaaaaaaaaaaaaaaacagaaaactttcaggacagtaaacctgtgccactgaaggagaggcattcctgtcactgctgtgtgacactgcagaaagtcttctcagtgaaacagctggtaatgtggtagtgtttactgacttgctcatattttaaatttcagtttgggaa

SEQ ID NO: 259712 - DNA, 409 bp, Homo sapiens
gggtgttaatgttcattccaattagcctattatggccaagatggcattagcccttgtgactctaagataaaagggatttttcccacaaatggccgacaagtttgggccaagttgtaaacattatttccatccatcttggactgcagcagagtctgtggtcagcgtgccagggaatatatgagaaaatcaggcagccttaatctctgcagcatgtggaaggaaataaagaccaccttgactgatggttgacttgatatgtctgaaggggattaagtctggctgtgacagaaatggctgcggagtcacagtgaagagaactcgatgaggtatggccttccaagtttaaacttctaatctcaaaggaccagagtgacttcataaggaattcaagaagaacgcaattcactca

SEQ ID NO: 259713 - DNA, 460 bp, Homo sapiens
cacactcagggagtgcaccatgtgaagactggacttaaacagctacaccaccagaagccgagagagaggctggaacatagccttccctttggaggtagcctggcccagtgggcactgtgatctcagacttccagccttcagaactgtgagacaatattttattgtttaagccacttattttttggtactttcttacggcagccctagcagatgctaatccagcgtgcgtcctggcagaggttgaagggggctcctcaagtcccaggtccagcttggtgtggttcagctactcgagagacatctgctgctaatggatgagcagtcaacctggacgcaggaaatcattttttatttgggtgaatacaatattctccttttgttttcacttttcctaaaagttaaatcaaggttcaaaagaaaatcgaggttcaaaagaaaaatttggtctttacatgtgcta

SEQ ID NO: 259714 - DNA, 1306 bp, Homo sapiens
ctatctcagaattgggcacatttctgagatattctgctgcaattgtgtaagatttgtctgcaagccttaattttctcattacctactttttataagtcaggcacaaataattggaactgcttatatagggaaaattgttgaggctttaaaatgtctcaacgccaaatgagaagaaagagaatacatattctttagtcttaatttggttccccaggagcaaacttgaatcctgaaacaagaattcaaactcacagagtttattttgtagggaggaagggaatgaagagaacacaggtaggggagaagagaaataagacaaggaagaggagaaaattaataaagataggcttctcaagccaattaccacagtaggcaactgaaacttaatcccgcatgagcacgctaggggcccgtgaaaaacacatgcttcagggtcccccgagggttaaaggagctgatgtatttatacaacaacatcatcatgcactactgccgggatcccaacagagccatccatcactgcttagatggactctctttggctcaaagcacttcacctagtatttacttttctcttactatttcatctttttttgtggatgacaggaaatcactggctaaccaataatcagataagcagagcatttgtggaaggaattcctcactctacatcttctcacgagcatggctaatttatttcagatctgatagcaattccacttacttagaatttggatgtcattcagtacacaccaggccacaactgaactggacagccccttttaaatttcaacaatactaacatctctcacaatagtttctagctcccagaaaacataatttctattctgaaagaggatgggattaattcacttaatttcaattcaacaaaatgtacctatgtatttatgtatgctatagctaaaataccattagtgtgtgtagatgatagatagataagatagacagacagatagatagatagatagatagatagatagatagatagatagatattccctgccttaacaaatttataatcaagagttgaagtagaaatgtataaaaatactataaaacaaggcatattacaattactcaaagcataaataaacaaggtgctatgcaccattaaggagatagcaataaattccaaccaggtgaaaaagaaggaaatttcatttccttcagaaatgaaatgaatttgagttatgtctaagtaaagttggctcctgtccctaactgcaagctccctacctgtggtcacgttcatggcttcagctgtccgcatttctgtgtccatgtt

SEQ ID NO: 259715 - DNA, 275 bp, Homo sapiens
acaaattttctctcatctctttatacataatggttcttggacttggaaaaaaggcagggagacctcactgttttactggttcatctgacatcaaaatcttgatagcacctattttaaacaagctcatctatggagtctctaaagaaaacttttctatacctgtttcaaatgatgtcccaaagcagcctagatcctggaatttttattaacatctacaataatttttagatagcacatcccctgctaataaaactcctctccaaacttggccccag

SEQ ID NO: 259716 - DNA, 428 bp, Homo sapiens
ttgaaagaaataatcagcagagtaaacacaccacccacagagtgggaaaaaatatttgcaagctacgcatctgacataggattaatacacagaatctacaaggaattcaaatcagccataagaaaaaaaaaaataataatcccttcaaaaagtgggctaaggacatgaatagacaattctcaaaagaagatatacaaatgaccaacaaacatatgaaaaaatgatcaacattgctaattatgagggaagtgcaaattaaaaccacaatgagataccaccttacttctgtaagaatggccataattgaaatccaaaaataataaatgttggcatggatctggtgaaaagggagaacttctatactgctgacgggaatgtaaactagtacaaccactataaaaaacagtatggagattcctaaaaaaaaa

SEQ ID NO: 259717 - DNA, 308 bp, Homo sapiens
accagagctgagcagatgggaaaacaagccgcagagaggagctaccctctctgctgagagtttcagagacctgcagagaccttgggactaccggttgcagagaggagcaacccactccagggcctcttctctgctaggagctgggcagacactgggacaatccccctgcagagaggagtcaccagggcttcctttctgctgagagatgaacactcaacaggacgacttgcttacagagaggagctacccgctgcggggctccttcaggctgttctaacagtcaataaagctcctctttgtcgtgctca

SEQ ID NO: 259718 - DNA, 364 bp, Homo sapiens
ggatgttgattagttgaggaaaaggattaagaataccagccacaatcatgagaccgactacataaatgaagactatagtagttataagcatttcttcttactttaatatgaatacttcatgtatatttcatccaatttttttctttccttcctccaccccgttaccctactactgaatgagatgctaataagttaactttatgtttcattattcaagttacagaatatccacaagggatcagctagaagaggaaggaacattacctaaacatgagtaaaatgatatgcagctttgtattctctattggaaagatggttagtgtattttcagtgatataaaagataattgtatcctgtaaggtga

SEQ ID NO: 259719 - DNA, 466 bp, Homo sapiens
  misc_feature (1)..(1): n is a, c, g, or t
  misc_feature (13)..(13): n is a, c, g, or t
nagaagacgacanaagggtcagttctgggaccagcactgcattcttagaagcctgggtccggccggggcccctgatgttgtggctgggggtccacagacctgggttctcagccccgctttgccacttcctcgccctgaagcctcagccaagttgcttccccgtctggacctgttcctcgtctgttaaatggggtgatcacccaccacccgccgcctcagagggacagtgaaaatggggagtcctgaaagccagagctggaaagtccccgaagagtccttacagaggaggcaggtgggaaaggagggagattgtccccggtcccacagccagtgggtagcagggccgtgaggttctggaaagagcactgcattgggaggtagcacttggcccaagcctcactcagctccttcctagctatgggaccttggccaagtcaaccaaggcccctgggccttttcctacaag

SEQ ID NO: 259720 - DNA, 571 bp, Homo sapiens
acatgcccgtcccaacccccaggcgacataccaaagtacttcacagaccctgtcctccctgccaccccacgttcacggactccacatgcctttcataattctgcaccagcgaagagcctctgaaggaatctttgaatcctgccttccaggtccccgccctgcacggtcacattcctttccagacgccatccagccgtgcagggcagcttgccctagagccaagctggtggccaggcctactccaggcacagagctgaccttcagcagggtctgttcacttccaggcatttcagcccgccctcctgttttacggctgttgatgtttgtctgtcaaggccaggttgagtgcagccctttgggctaagggtcctgaagaggcggagtcctcttcactttccttgtgagggcacaccttttttgaaaggagagacatggcacaggaccagttttctgaatttggaagcctagagtttcagagctggaaggatcttagacatcatcttggcagcccccacctgactggttcaggaaaccgaggttcagagggtctggctgatgtgtggaagtcacc

SEQ ID NO: 259721 - DNA, 477 bp, Homo sapiens
ctgcagagggtttcttcagagtgtttggctggagtactgatcaacacacgcgtatgtggaaactacccaagcctgggcaaataactagctgacagcattacaaggaatagcatccagtgctcacacagggccaggaagagtgcctgttcccaccagccaggcttgaaaacctcaagcatctgagaacattgcatagaggacaaggaagtgccttagttcaacaccaggaaaaaaatcctttactgagcattttgctagttccacctaacaaacattaaaaactagaactgaaataatcaaactgcttccaagtaacttaactgtgttcatgaaaaaaagctcaggagtatttatcaaaatacagaatcatacagcacccagtaaggtaaaattgacaatgtctagcacccaataaaaaacaatcaaacatggaaagaataaaaacatacaacccataaagagaagataaatcattca

SEQ ID NO: 259722 - DNA, 286 bp, Homo sapiens
aaattccagtaagtgctataattgccaggaaaatctctggttttgcctcattatcatagattcattaatttcacctttttatccatcttccatatctgatgatttttagtcctttaattctgccaaattttcagtcttctctttagctccggtcctttcttgacctcctctgtttttctgtgctctttttttgtatgaacttttcctgttttctgttctgaatttattcagagtagacctgcacacttcagcttcacaatagggaattccaataaaatgatgatgc

SEQ ID NO: 259723 - DNA, 336 bp, Homo sapiens
gagactttcacgggggtaccacgttctcccagcccagaagttaaatccatttgctctgcctgagcacctcccaacttccccttggggagatcccaccctccagcagttttgcagggaagctgtgctcttcccacaaaggcaggtgcacctgaacccgaggcatacacacacagcagcactggatgacccgccctccagcagttatgcagggaagctgtgctctccccacaaaagcaggtgctctccccacaaaggcaggtgcacctgaacccgcggcccatacacacagcagcactcgatgacccgccctccagcagttatgcagggaagctgtgc

SEQ ID NO: 259724 - DNA, 673 bp, Homo sapiens
atataagtttatgagctattaacattttcttatgaaagtaggaaactgactggctattctatgattcctgaggttcctctgggggaaaaaaaagcaaaaaaccttactcttcatgtcaataattgtttctactctagaccttactgaaagctgcctgttatgtataccacatgctctttcttgtctgacctgtcctaggttcagttttctttattgggttctcaattgttcaacacttatgaaatggacatatctcagctggtagcaaagagagtgagaaacatttagagaggggcaaataattgacaaacatgaagatactgagcccttccttccatgttgccaccaaccgttagcaagttggcttgccagaaaattaagagtaagctttgcagacagtttctgactcgcctgtaatgccagcactttgggagtccaaggcaagcagatcccttgagcccaggagttcaaggccagcctggacaacatagtgaaaccccgtctttactaaaaatataaaaattggctgggtgtggtggtgtgtgcctgttgtcccagctactcgggaggctgaggcaggagaatcgcttgaacctgggaggtggaagttgtggcgagtcaagatctcaccactgcactccagcctgggtaacagagtgagactctgccaaaa

SEQ ID NO: 259725 - DNA, 565 bp, Homo sapiens
atataagtttatgagctattaacattttcttatgaaagtaggaaactgactggctattctatgattcctgaggttcctctgggggaaaaaaaagcaaaaaaccttactcttcatgtcaataattgtttctactctagaccttactgaaagctgcctgttatgtataccacatgctctttcttgtctgacctgtcctaggttcagttttctttattgggttctcaattgttcaacacttatgaaatggacatatctcagctggtagcaaagagagtgagaaacatttagagaggggcaaataattgacaaacatgaagatactgagcccttccttccatgttgccaccaaccgttagcaagttggcttgccagaaaattaagagtaagctttgcagacagtttctgactcgcctgtaatgccagctaatttttgcatttttagtagagatgagggtttaccatgttgcccaggttggtctcaaactcctgagctcaagctatctgcccgtctcagcctcccagaatgctgggattacaggcatgagccactgccttcaactatgtg

SEQ ID NO: 259726 - DNA, 451 bp, Homo sapiens
ttttttttttttgagagaggggtcttgctctgtttcccaagctggagtgcagtggcgtgacctcggctcactacagcctccacctcccaggttcaagcaattctcccacctcagcctcccaagtagctaggattacaggggtgcaccaccactcctggctaattttgcattttttaagtagagacagggtttcaccatgtcgaccaggctggtctcgaactctcgacctcaggtgatccacccgcctcagcctcccaaagtgctggggattacaggcgtgagccaccgcacctggcccaagacatattcttgacacagacagtatggcaataaaaggaagacataaatttcttttaccataattaagattttgaatagtacacttgggacaagtaaccagcacatgaaaagttttggtttgagatttttaattactttgataaatcagaat

SEQ ID NO: 259727 - DNA, 422 bp, Homo sapiens
cactcaatgttgtcttatccaaacaacatctatgattcagccttcttgccctcaagtccagcatgttcccctctggctccaagcccctttccctccagccttttacaaccacatcactccatgtaagtcacttgtcctttgaaccagctgatctgtgggctgaggaaagggtgctgggagctgagctgtagatgttctctttgctgtctgtcattctaggggcttgccaacattgggcagagtctcctgctggctgaaactctctcaccacaaaggatttcattttatgtcagcagtttcataggctgagggagtgatagagataagagaaacatgaagagaatatgccacaatgactaaactcaagatagatttggggcagagatgtagagatttggtaaaagtccagaaatctaaaaaaa

SEQ ID NO: 259728 - DNA, 596 bp, Homo sapiens
gttctcagaacctccaatcatacattagtacttgctgctatggcaatctgtgggcatgtttttccactcctctgagcacttcattgactttttttctattatcatctacatcaaattcatgtttacccaacctaaattgtgtgggcattatctttctttcctctggttttcatgattcagccagcagaatttcactgaagacacctttccctcactgcagttccttcaccttttattggctgctccattttctccacaataattattgagcacctactatgtgccagatgttcttccttccaagcctcaggcaactcttcaggcattattaatctttttatatcaatgaggaaactgaggaataaaggaagcaagttattggctgaaggcaaacaaataccaagttgaaagagcagaattctaatctagatctgcttcacagctcctttccattccctgcctggccttttctgccaaacggcaccttattctcagaatatcctttttcatatatccataggctgcctccatttgttttttctagatctctagactcaaatctgccaaagagtctagcctatctcagccatatttgt

SEQ ID NO: 259729 - DNA, 372 bp, Homo sapiens
catcaacaggggcccattcccttccactcctgccatttttgtaccaacttgtctacctagttctaatcaatgcaaagagccaaccaattacaacagaagaaacgcctctaagtttcatctatcactaaataaacagtacgtgtttgtaagcctttacttctaactaaccttagtaaaatcaatgtaaaacaatttactggtgttttaatctttcttatttggggctaaaaaaatctaatttcctttctgtgattcacactctgtctcagggggtgctcttggaggatgtttcctagattggagctggctctttagcattctgtttttcagtacagtcccaacttctgcacctcatcaagtaaaaacaaacaa

SEQ ID NO: 259730 - DNA, 259 bp, Homo sapiens
gaaggaaggaaaaaaaagaaaggaaaggaaagtaagaaggaaggaaaaggaaagaaaggaaggaaaggaaggaaagaaaggaaagaaaaaagaaaagataggaaaggaaaagaaaagaaaggaaaggaaagggaaggaaagggaagggtaggaagaaagaaaagaaaaaataaaatgaaatgataaattacttactgggagaaagtttttgtaacctcaataacaaataaaaggtttgtattcttagcctgtaaagaaa

SEQ ID NO: 259731 - DNA, 407 bp, Homo sapiens
tctccacacagtaaaatggtgcccaatgggagaataaagtctccttgctccatagaaggcctgcactttacatgtatatatgagaaaaagctggtttctgttagtctataatgtattaagatgtggttagtgaaaaactgccttccaaaattcagttaatatagaaaattaagtatttttaaaaatttttcagactgcttattgtagaatgaaattggcccttgtcttatctcagccactttacccccaatctggacattttattataaatacagttctgctttcagaccatcatatttttggaaaagaaaattgtgtaaggtaaaagtgattacattcaacacatttaaggcaaatcatctgaaagttaaaaagaagtaaagacaatctgaattcctaccatatta

SEQ ID NO: 259732 - DNA, 349 bp, Homo sapiens
cagtgagaatgctttgtttttataggagctaggttaattttaaaaaaacttattagtaacttttgaaagtggaattcttatttacttaattccttgcagattattctttttcttggataggaagccaaaatactcttcagagatgcattgcctagttgagcaacttcaccatagcagtttctgtctgttgctgagaggctacctggtaacttcctacagccaaccatcctatgtgaactgtaacttccccttaagaaaaaaatatctatctttgacattattgtggcagatcctccagagagtctgaagacacgggctcttcctatatccttgtaactgaatttctagg

SEQ ID NO: 259733 - DNA, 2454 bp, Homo sapiens
gcaggagcacgtggagaggccgggtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgtgccccttggtccagacaccgcctgctcccacctcggagatggttccagttatcagcagcatgtatcccatagccctcacccgggctgagatgtcaaacggtgcccctcaagagctggaaaggaaaagcatcctccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactctgtcaaagtgatcgacaaggaaggggaggtgatggatgtgtatcggtgtgaccactgccgcgtcctcttcctggactatgtgatgttcacgattcacatgggctgccacggcttccgtgaccctttcgagtgtaacatgtgtggagatcgaagccatgatcggtatgaattctcgtctcacatagccagaggagaacacagaagcctgctgaagtgaatatctggtctcagggattgctcctatgtattcagcatcgtttctaaaaacagttgacctcgcctaacagattgctctcaaaacatactcagttccaaacttcttttcataccatttttagctgtgttcacaggggtagccagagaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaaacaaaaaacagcta

SEQ ID NO: 259734 - DNA, 335 bp, Homo sapiens
ggcccagccaatgaagatgaagacataggaggtgagccgtagtgtgcagactaaacactgatgcctgtagatattgcttaggcttagtgtagagaagaaatcagctctccaaggaaaacttgcaattgtaggtttagttaggagtgattctgttttgttaatttcacaaatatttgcatttcatagttgtaggttatcagcaaattttgagaatttaaggtgcttatccagtgttccaattatattaacttcacttaaaacatgatgtttgactattttccattataaaagtaatacatgtttattgtagaaagtttgtctggggtgttttctga

SEQ ID NO: 259735 - DNA, 963 bp, Homo sapiens
agaggcactgagagtggaggtctcagactcttggaaggggctatactagacacacaaagacagccccaagaaggacggtggagtagtgtcctcgctaaaagacagtagatatgcaacgcctcttgctcctgccctttctcctgctgggaacagtttctgctcttcatctggagaatgatgccccccatctggagagcctagagacacaggcagacctaggccaggatctggatagttcaaaggagcaggagagagacttggctctgacggaggaggtgattcaggcagagggagaggaggtcaaggcttctgcctgtcaagacaactttgaggatgaggaagccatggagtcggacccagctgccttagacaaggacttccagtgccccagggaagaagacattgttgaagtgcagggaagtccaaggtgcaagacctgccgctacctattggtgcggactcctaaaacttttgcagaagctcagaatgtctgcagcagatgctacggaggcaaccttgtctctatccatgacttcaacttcaactatcgcattcagtgctgcactagcacagtcaaccaagcccaggtctggattggaggcaacctcaggggctggttcctgtggaagcggttttgctggactgatgggagccactggaattttgcttactggtccccagggcaacctgggaatgggcaaggctcctgtgtggccctatgcaccaaaggaggttattggcgacgagctcaatgcgacaagcaactgcccttcgtctgctccttctaagccagcggcacggagaccctgccagcagctccctcccgtcccccaacctctcctgctcataaatccagacttcccacagcaaaaaagccagcggcacggagaccctgccagcagctccctcccgtcccccaacctctccttctcataaatccagacttcccacagcaaaaaagcc

SEQ ID NO: 259736 - DNA, 684 bp, Homo sapiens
ttttctcactttcagagctcctggcagctaagcaaaccctttgcaatatcctggcttttatactctcctctcctcctttccccttccctagcccaggcaactccccatctacactttgtctcctttaacaccctctgcctgcatgccaattctaatttttggaaccgcttcacaattaacctgcagcaactttccccatccccaactccccttagagagtctcttgagggaaaaaatgctctgtaaatcattccaggcccaacagcattgcactgcagcccttcttttatactggtttatgctgttaggctgaaatgatcaaggaggcatgaataattctttttcttgggtgtcctagaaacacttaaggtgccgtgtaattcatgcaaaattaccatgggagaattctctctcctgagctgttttgttctgtaaccctgtggacatgtcagttccaagaatggccctgtgtctcacaagttcaccatcagtttttcctctggaagtacctgctttattgacttttctaaaaccagcagcctcttattatttttcccctcaagtaaaatatccagacacaaaggttactggtagaagctcatagttgattgcatagggcttgtcgctgagatacatacacaagcagagtccacgggtattaatgagatgactgcaggcccgggc

SEQ ID NO: 259737 - DNA, 154 bp, Homo sapiens
gatcatagagtatggtcatagagaagagtggcctcactgttccagaaagggaacaaacctatggctttggaaggcaaagaaagttgacatttactgtgaatctagattctgtactaagtgtcatcacctgcgttgttttattctcacagcgacc

SEQ ID NO: 259738 - DNA, 427 bp, Homo sapiens
gcaccaggaatagtgcccattcttactagcctacatggtaaacataatccataggacatcaagtaaaatactcgtaagggtttttgcctgagtagcagggaaacaatgcctcacagtaaacactgctttggccctacctaaccatgcttgaaaccaagatccaaacagatcaaactgttccctaataatcagatctcagaacaatgctcaagaatatgtagagaaatacgaacatttcccacagccagagaaaaatttagtgtctgtcaagtaataaaaagctaccagacatgcaaagatgcaggaaaatatgactgatgaggaggaagattaatcaatcaaaactgttttgtaaataatggaagacaaaaatagcacatatactcaaatatctcttgtaactgtactccacatgttcaagaaacac

SEQ ID NO: 259739 - DNA, 703 bp, Homo sapiens
aaagaacaaacagttatctctcattctttcattctctcaataaatatttattatgtactctctaaaggaaatatgcattgttaagccaatatgctataaatcaaccacacctacaaattgtttttaaaatttaaatgaaatgaagttaacatgttcaaaagaaacaaaagtctactcaggttaaagagtcataggcaaaccaacatactcaatctgaagttaccgtttctaggaataatgcaattaaaatggacttctgctaaatactacatggttgataaacaacagtgtcaagttaaatttacttataatctacaaatgtattagataactgctgccttttatttttgattagttatattctagcgaaattatgactaattgataaagttgtcctttcttccaaagtaaaaaatcgcatgacaatataggagatctatcaccatgaattaatttatcttcagaaaatctttcactgtttttcttttttgctgtcaatatttgacaaagtaagctttgagaaggaaaggaactaaggcattatttccaaaattatttgattatgaaaactagttattcaaaattaattttgaaattattaaaggatttataatttttagaagtctggatagtttcacaatcaaaaataaaactaatcttaagattcttatgtgaacttcaacacaatatgaaagtctatttt

SEQ ID NO: 259740 - DNA, 670 bp, Homo sapiens
gagagggtgcaaaactttcctaaccattacaaagcacagcacttcagtctgtggggcacagctgggcacagctggaagacagtagttaggcagaatctgcagcaaaggtgctgttgacttatgcgtttgagaacaaagagtctggactgatctaaagtgtttatgtgccataaatctgagagagcagcagacatggggagcaccagctactgaccacgtcaaaagcatctgttccctttctacagtatggcaaagggctgtccactcatagtggcctcttcagcctaagctaccacccaggtggtaaatgccatctgcagggtcatctttggatgaccaaaggcaggaccccaatttctgtgattctgtggggaaaatctggttgttctgttttcttatctgcctcccttcaggatgggaaagaaaataggcagggaaagcagagatagagaggtgcttcccaatagtgtccacaactcttcaggttccagagtagtgtttctcaaactttattgtgtatgagaatcacctgcaggtgatggttaaaattaaattttaaaatatattgttaaaactaaattttttttttttttgacggggtcttgctctgcaaccaggctggagtgtagtagtgtgatctcggctcactgcaacctcagcctcctaggct

SEQ ID NO: 259741 - DNA, 111 bp, Homo sapiens
gagccgtgctccccccgatagagcctgcaacgtaaaactttagatttagtctgtggtcaaggcacacaggattatattctagtaaaaagtttatgacagaaggtaaaaaaa

SEQ ID NO: 259742 - DNA, 182 bp, Homo sapiens
tgattgcaccactgcgctctagcctgggtgacagagtgagaccctgtctcttaaaaaaaataaaagaagaagaaaaagaaatgagtagagagggtattccagattccaggtacagggaacagcataagccatgatatcgagatggaaaagaccctaaatttgacttttccaataactgatcc

SEQ ID NO: 259743 - DNA, 4736 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatggtctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259744 - DNA, 5069 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatggtctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaactgcctggcctgtcttatttgtgctccttgaccaaatcagccattatgtcatctcacccatgtgtggagggtgagactctcttggtaagaaatagccacagatattagagatgaaaacactttgtgaggtcagttcatcttcagttggcgtcaggtcgggcctcagtcattattttctagtgtttcataaccaaagtgagtaatggatgggaggttgaggtgggaagatggcttgagcatgggaggttggaggtgcagtgagctgagatcattcctgacaggaccaacccaagtccatacctaaaggcagggggctaagggggcaggtgagg

SEQ ID NO: 259745 - DNA, 4361 bp, Homo sapiens
tttggttgttgttgtttgttttttgtttttgagacagacaaaaaaggaaaaaagacacacacgcacaaggacatatgagtagagacagtagtccacagatgctcccaggagaaagaaatccctgagtcagaaaagatgtcctgaagtggtggtttgaggggggcttaaagagaggcagaatctgcaaggggactgaaaaagaaaaaggcaggtgttgaggctgctctacagacggcaaggcagtggggctgtgtcggagacgagaggtagcagcctcttggcctcagccagatgcccagcccagtcctcttctcctgtgggtgtcctggagtggtggtggtggctgagttggggagggcaaggtggctctgatgattctgccttttctgtgcccccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatggtctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259746 - DNA, 4387 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttgcttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatggtctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259747 - DNA, 2549 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259748 - DNA, 2263 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259749 - DNA, 4314 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatggtctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaaatgagccgggcatggtggtgggtgcctgtaatcccagctactcgggagactgaggcaggagaatcacttgaacccgggaggtggagggtgcagtgagctgagatgggccactgcattccagcctgggtgacagagtgagactgtgtctc

SEQ ID NO: 259750 - DNA, 1445 bp, Homo sapiens
gagaaaatatttgcaaactatgcatccgacaaaggacgaatatccagaatctacgagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagta

SEQ ID NO: 259751 - DNA, 3779 bp, Homo sapiens
ggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaactgcctggcctgtcttatttgtgctccttgaccaaatcagccattatgtcatctcacccatgtgtggagggtgagactctcttggtaagaaatagccacagatattagagatgaaaacactttgtgaggtcagttcatcttcagttggcgtcaggtcgggcctcagtcattattttctagtgtttcataaccaaagtgagtaatggatgggaggttgaggtgggaagatggcttgagcatgggaggttggaggtgcagtgagctgagatcattcctgacaggaccaacccaagtccatacctaaaggcagggggctaagggggcaggtgagg

SEQ ID NO: 259752 - DNA, 574 bp, Homo sapiens
gattgcaccactgcgctctagcctgggtgacagagtgagaccctgtctcttaaaaaaaataaaagaagaagaaaaagaaatgagtagagagggtattccagattccaggtacagggaacagcataagccatgatatcgagatggaaaagaccctaaatttgacttttccaataactgatcctgaagacaaggcctgggtctccctggctagtaggctgccaggtacctggggtcagctgtaggactgacctctctggtacattttcttttcacccccagtgatagaggaaggcggtgtcaaaatgaagctgaccgtcatcgacaccccaggctttggagaccaaatcaacaatgaaaactggtatctgtctgcctctgagatctttgccctaaagactctgctgggaagatacttactatggtgcagattcattcacgttgagaaccatctgcaccctccatgctctgtagttcccgacagcccaggccagggcccctggggagctccacccctgctaactaaccatccaggaaagccatcggtgcgggggctgagggggaatctggcagcagg

SEQ ID NO: 259753 - DNA, 6016 bp, Homo sapiens
atccttcctcaaaattcttgaagtagttgtctgctttgagcctgccaccttcttcatctgataatacaagaggtatacctagtccagcactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactgatcgtgaaaaccagtcaatcttgattactggagaatctggtgcagggaagactgtgaacacgaagcgtgtcatccagtactttgcaacaattgcagttactggagagaagaaaaaagaggaacctgcctctggcaaaatgcaggggacccttgaagatcaaatcatcagtgctaaccccctactggaagccttcggcaatgccaagaccgtgaggaatgacaactcctctcgctttggtaaattcatcaggatccattttggtgccacaggcaaactggcttctgcagatattgaaacatatctgctagagaagtcccgagttacttttcagctaaaggctgaaagaagctaccacatattttatcaaatcctgtccaataagaaaccagagctcattgaaatgcttctgatcaccaccaacccatatgacttcgcatttgtcagccaaggggaaattactgtgcccagcattgatgaccaggaagagctgatggccacagatagtgctgtggacatcctgggtttcactgctgatgaaaaggtggccatttacaagctcactggagccgtgatgcattatgggaacatgaaattcaagcaaaagcaaagggaagagcaggcagagccagatggcacggaagttgctgacaaagctgcttatctgacaagtctgaactctgctgacctgctcaaatctctctgctatcccagagtcaaggtcggcaatgagttcgtaaccaaaggccagactgtgcagcaggtgtacaacgcagtgggtgctctggccaaagccatctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcagagggtggtggtggaaagaaaggtggcaaaaagaagggttcttctttccagacagtgtcagctcttttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggttctaaatgcgagtgctatcccagagggtcagttcattgacagcaagaaggcttctgagaaacttctagggtctattgaaattgaccacacccagtacaaattcggtcataccaaggttttcttcaaagctggcctgctgggaactctagaagaaatgcgagatgaaaagctagctcaactcatcacgcgcactcaagccatatgcagggggttcctgatgagagtggagttcagaaagatgatggagaggagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagaaagagtttgaaatgagcaatctgcaaggcaagattgaagatgaacaagcccttgcaatgcagctacaaaagaagatcaaagaattacaggcccgcattgaggagctggaggaggaaatcgaggcagagcgggcctcccgggccaaagcagaaaagcagcgctctgacctctcccgggagctggaggagatcagtgagaggctggaagaagccggtggggccacttcagcccagattgagttgaacaagaagcgggaggctgagttccagaaaatgcgcagggacctggaagagtccaccctgcagcacgaagccacggcagctgctcttcggaagaagcacgcagatagtgtggctgagcttgggaagcagatcgacagccttcagcgggtcaagcagaagctggagaaggaaaagagtgagctgaagatggagatcaatgaccttgctagtaacatggagactgtctccaaagccaaggcaaactttgagaaaatgtgccgcaccctagaggaccagcttagtgaaataaaaacaaaggaagaagagcagcaacgcttaataaatgagttgtcagcccagaaggcacgtttacacacagaatcaggtgagttttcacgacagctagatgaaaaagatgctatggtttctcagctatcccgaggcaaacaagcatttacacaacagattgaagaattaaagaggcagctagaagaggagactaaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacaggagatttctgacctgacagagcaaattgcagagggtggaaagcatatccatgaactggagaaagtaaagaaacaacttgatcatgagaagagtgaactacagacttccctagaggaagcagaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggacactcagctacatttggatgatgccatcagaggccaagatgaccttaaggaacaattggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcagaacaccagcctgatcaacaccaagaagaagctggaaacagacatttcccaaatccagggagagatggaggacatcgtccaggaagcccgcaatgcagaggagaaggccaagaaggccatcactgatgctgccatgatggctgaggagctgaagaaggaacaggacaccagcgcccacctggagcggatgaagaagaacatggagcagaccgtgaaggatctgcagctccgtctgggtgaggctgagcagctggcgctgaagggtgggaagaagcagatccagaaactggaggccagggtgagagagcttgaaagtgaggtggaaagtgaacagaagcacaatgttgaggctgtcaagggtcttcgcaaacatgagagaagagtgaaggaactcacttaccagactgaggaggaccgcaagaatattctcaggctgcaggacttggtggacaaattgcaaaccaaagtcaaagcttacaagagacaagctgaagaggctgaggaacaatccaatgtcaaccttgccaagttccgcaagctccagcacgagctggaggaggccgaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaa

SEQ ID NO: 259754 - DNA, 937 bp, Homo sapiens
  misc_feature (116)..(116): n is a, c, g, or t
aactttggcagaaaataaaaaaggaacactttgcagctcattttatgaagtcagaatacttgatcctaaacttgacagtgacattcaaggaaggaaaattactgagcaatctcacnaaagacagatataaaacctcaaccaaatcttagcaaatcaaactcagtgatatataaataacccaattacaattaaccaggttttattcttaaaaaccaaaagtaaacattggaaaatcgtaaatgtaattaccagtatccactcaccaaccaaaccaaaaattcttaccagccaggccaccagtggctcagccctgtaatcccggccctttgggagggccgagttgggtggatcacttgagttcaggagtttgagactagcctggagcggatgaagaagaacatggagcagaccgtgaaggatctgcagctccgtctgggtgaggctgagcagctggcgctgaagggtgggaagaagcagatccagaaactggaggccagggtgagagagcttgaaagtgaggtggaaagtgaacagaagcacaatgttgaggctgtcaagggtcttcgcaaacatgagagaagagtgaaggaactcacttaccagactgaggaggaccgcaagaatattctcaggctgcaggacttggtggacaaattgcaaaccaaagtcaaagcttacaagagacaagctgaagaggctgaggaacaatccaatgtcaaccttgccaagttccgcaagctccagcacgagctggaggaggccgaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaa

SEQ ID NO: 259755 - DNA, 568 bp, Homo sapiens
ccaagaggttgaggctgcagtgagtcatgtttgcgctaccacactccagcctgagctacagagcaagaccctgtcccccacctccccgcaacaaaaaggagttaaaaagaaaaacaatgaaaaacaataagaaaggggtgtacagaagcaaagaaacaagcattaaagggtaggtgggcaaaagtgtcaaatgtagaagcaaggtcaaataggagagaatggaaaagagctcatcgaatttaacagttaatgacatttgtgagagcatcactagtagagcaagcgctttgttcaatactctctcaaggaccttaccatactttattataattagttagaattgattcatctcccttaccccatccccaaatgaggaaggagactatcttgctcatttctgtatattctctaggagctaagtactttgcaaacagtaggaactaaacatgttaccaaaataaacttgttcattagtcttggtcattttaaaaaatattttcacagtaataagaaaatctagaaaactgtcttttaactacactccaaagataaaaatatatatattctg

SEQ ID NO: 259756 - DNA, 892 bp, Homo sapiens
agccaccgcacccgtcacttgatctcttttaaagggaggactgtactctggactcaccctcacccttgcacttttggaagcgttcctggacattagacccatcctctgaaaggaacttgtcctgttccttctcctcagtttctgtacacgtccttactgtgcagagtgcacacgggagcgcactcagggctgggtgaggaaacagacaaaccgtccttgagaaacgtgaggtctgcttaggaaggctgcaggaaggcacagaggagagccccggaagggagggagctggtgctcagggagggctgattttcagcagacgctcaatttggaaagcctttgggggaaaggtaattgctcagaattgcaaatccttttcttcatgtttagcgttaaagaataacagcccacgttttctctgaaagctttaaaatttctgaatcattagagtccagtcaatgtggttttaatacatgtagcaacagaatgaaggaacatccatcctgggtttgatcaaattacaacagccttaaattaccttagaaacatagttactttattctatttgtgtctacattaaatgtctcattaattcctcatattttctggagtcttgttggctggcaaatcacaagtaatctttcttcatttgcccttggagttgttgtcagggagatggattggagaataaaataggttagaatctattctgatgctgcgaactgggttcttttacgttttcaggacagaaaatagcagctccccaattccacagacttactttgcgtctcgtaagtgatggtggtggtgacgcaggggcagggcttctggcccgtgtcacgttcttctgctcacatggctggagtatggccccaaagtcaccttttctgcttcc

SEQ ID NO: 259757 - DNA, 980 bp, Homo sapiens
atatcatttcaggtagcaaccatctagatttgagaaatatcttgatatatctttaatggcatctagaacaatatgcaataaaacttagtctctgattataaacagaaagtggttaggaatttgaatataaaatgttcttggttaatgtaagaagcgtgctccttctgtcgtaccctaatgtgtgtatatatcgtgtatctattgggcagtttaaatgtaataacgactgtaatactgacataccttgatacaaatgtttaatcctttagtgaagatttcaaaaattgtgcagctttttttttaatcataaaatggtgttgaagtttgtatcaaggtaactacagttttacatatttaaatctatattacaggtttcttcatgggtctaattttgcctctcaacctgtctttattgccaataaattattgtagcaattattgtaaaaatatttgaaccttagaatatcatcttcattatttttatgttctatcatgattctccatgatagaatcatggaggcaagctgatgaaatccaacttcctcattttaccaatgagaaaacaaagacctagaggagtactgggaatagccataggtgatagaataggtaattaaatatatctgtcaagactaatatataaggaagcttgatgatgatttactacttattacaaactactgggccttctaaggtaagattgcttctaaggtaaaagacactaatactatctttgtaggtgaaaaatgatacaatgatgatgcatgttctgttacatttcagaaagaaacacctccctatcagctaccccgatgagaggggagggggcctcaagccatgtttatcccaacttttaaatcacgtgaccataacatattttaaaataaaataatttgtacttgatttaaatataagtgaaataatttgggagaataatttatgtatttataataaatgtaattatgaattgaaaaaaaaat

SEQ ID NO: 259758 - DNA, 691 bp, Homo sapiens
ggtggtgttctagaggtccctcacgccatttcacaagaaaaagagggggcagaaccctcgggagacccctgcaggactgcaagaactgggctgcatgaagccacccagatgccagggctgcgtgttacggcagctagcctgcctggggaacacacagccccttccatacccgtggctctccttccctgcagagcctcgcaccggtgtgtgtgttggtaaacagggtcacctagtccacacagggagccaacatgcgagggaggagagccaggcctgggtctgctcagactgtgtgctccaattttcagatatcctggacctctaaggaaactggcactggcccaggacacccagagaagctagcagcagtcccggtgtgatcttccttctccatatgaccccacctgagctggatgcagccagcccagcccaagggaagcacccagatggctgtttgattccatacactcaaatcctatatccaccagggaccagacgatccagaccacgtgcttccctccaaaaagagttcgcccagcacaatcagtttagtcgctccgtccaccctaccatttctgacagtagcttgaaagcagtagagccacgaacaaaggatgccatgggaagtgtgtcggcaaagacccttgcagctggctcagcagcccacctgggattcaaacccagactcctg

SEQ ID NO: 259759 - DNA, 896 bp, Homo sapiens
ggtggtgttctagaggtccctcacgccatttcacaagaaaaagagggggcagaaccctcgggagacccctgcaggactgcaagaactgggctgcatgaagccacccagatgccagggctgcgtgttacggcagctagcctgcctggggaacacacagccccttccatacccgtggctctccttccctgcagagcctcgcaccggtgtgtgtgttggtaaacagggtcacctagtccacacagggagccaacatgcgagggaggagagccaggcctgggtctgctcagactgtgtgctccaattttcagatatcctggacctctaaggaaactggcactggcccaggacacccagagaagctagcagcagtcccggtgtgatcttccttctccatatgaccccacctgagctggatgcagccagcccagcccaagggaagcacccagatggctgtttgattccatacactcaaatcctatatccaccagggaccagacgatccagaccacgtgcttccctccaaaaagagttcgcccagcacaatcagtttagtcgctccgtccaccctaccatttctgacagtagcttgaaagcagtagagccacgaacaaaggatgccatgggaaggcaggagtctgggtttgaatcccaggtgggctgctgagccagctgcaagggtctttgccgacacacttcccctcaccccttcctcgctggcaaaaccagaggtgaatcagagcactagtgtgttctagatcctaggatccttagagtgtagttatggacaaagggagttgcgttttcaaagttctgctgggctttgtcatttaagaatctcttaaggcactgctaccagggctattcttcactatttattgggaggcagccaggtttgc

SEQ ID NO: 259760 - DNA, 242 bp, Homo sapiens
tggtaaggacaagtgtccttctggtttgaatactccggttactataaaatttgtgttctgtgaggtatgtcttttctggtgaattcacttctggttctgcatgcctaatttagtattttgtttaatctgcatacctgggtttaaaattttttcttttttttttttttttttgaaaaggaattaaacctttgtccccaaggttgatttgcgtggcccccttttgggcccaggggaaggctctg

SEQ ID NO: 259761 - DNA, 530 bp, Homo sapiens
tggtaaggacaagtgtccttctggtttgaatactccggttactataaaatttgtgttctgtgaggtatgtcttttctggtgaattcacttctggttctgcatgcctaatttagtattttgtttaatctgcatacctgggtttaaaattttttctttttttttttttttttgagacggagtctcgctctgtcgcccaggctggagtgcagtggcgggatctcggctcactgcaagctccgcctcccgggttcacgccattatcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtaaaatttttgtgaatactcttatcttggtttcattttggtttggtaacacacatctgtaaataatttagcttttttc

SEQ ID NO: 259762 - DNA, 1173 bp, Homo sapiens
attagtgagttttttcataagacaaaattcaaaaagattaatggatctttactgaaatgaaattcaaatacgagtatttgtcagttgcataatatgcactgctattttaatgttccacaaaattttccatttttacaggccattactgagtcttataatttatttagacctgttctgttgtgtagagtgtcacatttgttttcattagtaagtataaacacactagttaaaagtgaaattgcttatacctgtactgataagtgccaccagtagagggcggcagtgaggcactagaaagaagaaccaactttactgtcagaaattgcagaaaaccgtcaagatgggggttgatgtgaatgacggcaaacatttgttggtgttggcatcctcattaacacccagactggcttattttatgggccagaagctttgacataaacattgtcacagaattttcagataatctgataatgtacttataaagcaaattttgtggaaatttctggtaagactgatgagaatcaacattaagagatattctaaaaattttacattatttcaaagagacaagagtatgaattaaaattaagcatgctgttcttgtcacttcaagagtgtaggcagagaatttaatactttagagatgacaaaaggcatcttaccttctttgaacactacagatatccctgaaataaaaagaaatatttccaacttatcaacagtaagcaatgcacaggattaatcaacaagataggttacccagatttagcttgcatctgcttttataaacatttaacaacaacaaatattttttgagcacctactatgtgctaggagttattcaaggtactgaggttatagaagggaacaaaacaaactcatttcctgccttcttggagtttaaattatagtgaggaagacagatattaaacaaagctgcataattaattcattagttacaatggagaaaaacaaaaaataggaaacaatctaccacagggccccagatcaatgagtttggcctcaaatcaaaaaggggaaattaagtgaaattgaaataggactcaagaacgaattaagttcttaatacccatttatgtcatttatttcccttaaaaataaataaaatagataaggtaaaattaacagattcatggaaataacattactaaa

SEQ ID NO: 259763 - DNA, 206 bp, Homo sapiens
agtcgtccttccctctccctgggtgcctaagagaaaataccgtatagaaaggaattcctgaagtctaaacccctctagtgaggacaggagtgttactggaaagggaacaagcgagatgatacactcttcaaataagttttgccagtggtaagaaatggcatgtagttttaatttataactcttgtaaagatggcatattcttgcat

SEQ ID NO: 259764 - DNA, 776 bp, Homo sapiens
gttggttgaaaataaattgattgaaatgaaggtataggacatgtgagtgttattaggccattttagcaattagcttttaaatttttgcttggtcagttctttcttctttgccccagtgcctttgctccccaccctactcctcttttaacagtcttcccgtggtttctcattgctgcaagttccttactttagcacacattctaattatttgtgatctggcctgcagtattgccagcttctgctcttgtttctcatgtccttcccattttgtgccctagtcatactgaactgcctaggattgtgttgtcccacatcatagccattagtcacctagggctgttgagcactgaaatgggatttgttcaaattgagctgtgctgttgagtgtaaaatactgatgttgaagagttagtacagaaaaaggtaaaatcttttttttttaatggttacatactgaaatagtagtttgggtatattgggttgaatcaaatatattattaaaatgaattttacccatttctttttactttttaaatgtactgttggaaaatttaactttacatacggggctcacatttgaagctcacattgtatttgcgtggggcagcattgggctggagtatgctggagaagcatctgtttatcacccctctttgctttagtgtaagctcttcactgtgactggaaaggcccagaaccctgcccctcccgacacagcacatacacacattgacgttttgctactacagcatatagcctttgctgggaccctctcc

SEQ ID NO: 259765 - DNA, 454 bp, Homo sapiens
tttttcctatgatctttccctgccgtgtctcttagaagacaaggtatccaggtatgaaaaccaattttgcagacattgtttaggatactaatggggaaagtcttcagtaacttttgttgaaagaatggatttcctgagtccttacagcatttagttaaataagtgtagatttctagaatcagagctaatattcctagacacttggtttagctgttactaactcatgaaccacagaaagaagaaataccttagaccatgcaagtttgacgatgtctgtgaactttaccaactttagtttcagaattccatctttctaccttcccaaaaggttgaaagtgatatggacagtgaagtctgattaattgacagaacttttccatgttaataaaaattccggtaaaatggtttccttgttactagagatatagtttgggattccccaggctgaaaaaaa

SEQ ID NO: 259766 - DNA, 815 bp, Homo sapiens
agagattcctgtgccaacatcatactgttctagaattactggatctcttatgctagggctgctggtcaaacctgagttcctgaaacctttaaccctactcagccaatacaaccgataacattcctgaagagacagagtcttgttctgtcgtgcatgctggcgtacagtgccacaatcacagctcaccgcagcttccaacttctggactcacatgatccttctgcctcagacttccaagtacttgggactacagtcacgaatcaccacagccagcttggagtgactttctaagggattccatccaagttaccacattatatttgttaatcacgtgttctttggcttctcttgtttgtgacagtttctcagacttctgttttgctttgttctcaataaccttgacagttttgaggagtagtgataagaaagttactatgcgcagaccactcttagggagtgaagaattatgatgcccctccttgagaatggagtacttacataaattacttgggactcttctgcataggagggtcttgctcaggctggagtacactggtgcaatcatggctccctgcagcctcaacctcctgggatcaagcaatcctcccacctcagcctcccaagtagctgggactacaggtgcatgctattatacccagctaattttttaaattttttgtagagacaaggtctcactatgtttcccaggctggtcttgaacgcctgggctcaaacaattcccctaccttggtttcccaaagtgctggcatgagccactgtgcccagactcattatttattaaactattttgtggc

SEQ ID NO: 259767 - DNA, 374 bp, Homo sapiens
tgagcttgaacctgataagcctggcagaagcctgatgaacccagaatgagtgagatgtgagacagagtcttgttctgtcgtgcatgctggcgtacagtgccacaatcacagctcaccgcagcttccaacttctggactcacatgatccttctgcctcagacttccaagtacttgggactacagtcacgaatcaccacagccagcttggagtgactttctaagggtaaataacgagtcaattgagactgtaattatatgacttggggcaaaattaactgtggtcagctgacttgttaccgtatttaattttaattttggagcttgtattcaaaagctattatatgaatataagaataaatgatttttttaacaaa

SEQ ID NO: 259768 - DNA, 425 bp, Homo sapiens
gtgcatgcgtgtgtgttttcaaatggttagttttttttctgtatttattgttaaatcctagatgtagtaaggtcaatgaaagtagataatatagcatttactttttaggacttactgaggttttctttatatacaatcaatttttgtactccatgggtacctgaaaagaactatattttcatttatagaaaaccaagcttgttattattattattattaggcagagtcctgctgtgttgcccaggctggagtgcagtggcccaatctcagctcactgcaacctccgcctcctgggttcaagtgattctcctatttcagcctcccgagtagctgggattacaggcgcccaccaccacacgtgactaattctgtgtttttggtagagattggctttcaccgtgttagccgagctggttttgaactcc

SEQ ID NO: 259769 - DNA, 509 bp, Homo sapiens
tcagagagcacgttggccctacaaatgcaaatccaacattcagccacgacctcccatgtgccaagtgtcatgggattcatgctttcaaaccatcggttccacctcttgttcctggtcaatatcctctgcgcttctctttggggatttaggacaccacgacattctcttcattgtccaaggaaaccattctcctcatctagaaacatcatcgatttctgaagttaaattgagaccagagtggattctgcacatcagtctctcccctttccctctgtgactgtggactctgggagggttgaagggaggtggtgccaatggcaaagacatgctctgatggtgcggcttttccacaggcctttcttaagctgtgactgggtctcagatctttcttcagacctgagggatgtttagagtggaggatgtttgcaaccatcagtcttccgtcatgttacactggagtttcgtggcagtgacgtgaattaaagagtaatattttagatttgaaaatt

SEQ ID NO: 259770 - DNA, 725 bp, Homo sapiens
tcagagagcacgttggccctacaaatgcaaatccaacattcagccacgacctcccatgtgccaagtgtcatgggattcatgctttcaaaccatcggttccagttaagactcatataatgaaacagatgggttcacatgattttagtttatatgggaagaagctttagactaaagcagagggaggtaaacttacaggcaagcaggaaggcttgaaggcttgagtgttcttggaggctcacggctgggtgcaggctgaccttgggtgagagccctcgttcattgccccgtgacactgtccttcctgtgttttcaaacggcctcttgttcctggtcaatatcctctgcgcttctctttggggatttaggacaccacgacattctcttcattgtccaaggaaaccattctcctcatctagaaacatcatcgatttctgaagttaaattgagaccagagtggattctgcacatcagtctctcccctttccctctgtgactgtggactctgggagggttgaagggaggtggtgccaatggcaaagacatgctctgatggtgcggcttttccacaggcctttcttaagctgtgactgggtctcagatctttcttcagacctgagggatgtttagagtggaggatgtttgcaaccatcagtcttccgtcatgttacactggagtttcgtggcagtgacgtgaattaaagagtaatattttagatttgaaaatt

SEQ ID NO: 259771 - DNA, 427 bp, Homo sapiens
tccaagtacatgaaacagaacctgcaaataagagtgaatgacgaatagaaagaccacctcaacctgtccacttccctacggccgcagaagttatgattcaaggaataatgagactctaaatcctttaaaattctacaagagcagcctttgccaaacccagcggggagtggctgctcggtgccagcgcgaggagcacgtagactgccgatgccagagaagcccggtgcgggttccgtgctttctctccgttccaggaagaccccagctcgtggccaaatcttcttgccgcttcccggtctgcgcgcctacgctgccggtttcccgacaaaagcgacggcgccctggtgaaaagcagacgcccctcatcggtttgcgccttgcagctcaactatgccccagcctcccacaagccacctgcccgcgtcct

SEQ ID NO: 259772 - DNA, 387 bp, Homo sapiens
actaagatagtaaccttcaagccacacaaacatctcatggtagagagtaaacatgtatctagtgaaatggggcttaagtgtaatctttgtgaagtaagtgccttataattacacaggggtgaccccccagatagtcaggttgaaagacaaaaatagagagaaaaataactcagaggctacacgctgagtgggaaatagacttacaggaatagttcacccaagacattaaacaaactagcaagtgaaaaaccagcaaagatcacagccacttctggagtgggtcagtacccaaagttgcaataataaaatatctaaaatgtcaaattctcaacaaaaaaaatacgacacatgcaaagaaacggtaaagtgtgatgcatacacaggggg

SEQ ID NO: 259773 - DNA, 447 bp, Homo sapiens
tacttgtaagaattgtcttttttctttttctttttctttttttcaatagagatggggatctccctatgttgcccagactggtctcaaactcctgggctcaagcgatcctttttgattttgggagccctcctctgcctcccaaagtgctgggattacagtcatgaaccactgcacctggcccacttctaagaatttaaatgttatttatttgtgtttttatatgtttgtgtaaagaaactggaaggatctgcagactaataaaatgaatacgtattatagagggagtgggggctggcaaattagggggcaagggcaagaagtcgattcttcactgcctagcattctttcatttttttatggatccatgtgaatgcattgcttattcataagattttaaatgagttaaaatatttaaacattaagtgtacaaagtggagataaaaaaaa

SEQ ID NO: 259774 - DNA, 705 bp, Homo sapiens
gggagaaatttgattgcaagaacttcatcctgaagcatataggtcctggcatcctgtccatggcaaatgctggacccaacacaagtggttcccagttttcatgtgccctgccaagactgagtggttggatggcaagcatgtggcctttggcatggtgaaggcatgaatattgtggaggccatggagcgctttgggtccaggaatggcaagaccagcaagaagatcaccattgctaactgtggacagctctactaagtttgacttgtgttttatcttaaccaccagaccatttcttctgtagctcaggggagcacccctccaccccatttgctcgcagtatcctagaatctttgagctttcactgcagttccctttgggttccatgttctccttattcctttcatgcctagctggattgcagagttaagcttatgattatgaaataaaaactaacagcaacaacaaaaaaggatacacctaatccacagtttcttatgaaaccctggaggccagatgtattttggaattgcaatgtatttacatttttgaaaggttaatatggtgaatgtaacacttcatagtaaaatgcaaaatttccagtgaaccatgtgaatattcaactaagtggaataagtaaaggctataaataactatgtcagttcaggtcagagttttctgcaaaatgagtttttataccaaaccaaa

SEQ ID NO: 259775 - DNA, 256 bp, Homo sapiens
cacttcttggactttgaagccacctttggccacaaggggaatgcaaagagaactactgtcaagaacctggatacccacagagctattaaaaggccttggaacccccagctccagccttcttgttaagcaaacaatggatgtctctatagtttaagcttctgagggttgtgtgttctgtaatgggaaaatctgtggagttattgctaggaatggtaatggtgaaatcattaaaacacagaccccaattcagagtcaa

SEQ ID NO: 259776 - DNA, 371 bp, Homo sapiens
cggcgcctaataataataaattcggggccggtcgaaaaagggctctcactctgtctcctaggctggagtgcagtggcacaatcacagttaactgtgacctcgaactcctgggctcaagagatccttccacctcagcctcctgagtagctgggacaagtgtgtgccaccatgcccagctatttttaagtgtttttgtagagatgggggtctcactatgttgaccaggctgatctcaaactccagggctcaagtgatcctcctgctttggcctcccaaagtgctgggattacaggcgtgcaccactgcgcccagccctaggcactgactttatagacatggttttattgatacttcagcgcaaccctatcact

SEQ ID NO: 259777 - DNA, 847 bp, Homo sapiens
ctctgaataaaatatacaagttataacaatgtagcaattgacccagcaaatgaggacacaaacgtgttggagggtgtctacagagaaatagacaagcgatgcacgacagatacatgtgtcagtctggtccctgcagttgtatttgtaataatacacattggagcaatttcatggccatcagttagagaatgtttgaggaatgatccattcatatcaagaaggacatttcaaagatcaaagcctgatggaaatgctggagaccatggcgctgataggagctcatgcgtgttgaccaattactacatgacaggcattggctccaggcttttcctgcactgctcatttaaacactggacaacctaagtgttctgatttagcccattggacagatagaaatggaggcacagaagattcatgtgtttaacttcaaaccctggcagattaggtttttcatccagagcctgtgcttcaccatagctgtgattcacgttctgtcattttccactttaggaatttccagtattccaaatatgagaagctgagaaaacaaacaacaaactcaaaaccctaaaaaccaggatacgtaagggtagatgtttgttgggtgtggatttaaaatggactttttttgccccaagcaacaaagaggcaccttagaaaatagacaagagacaagaagaagagaagctttaagagatatttggtccaaggaagagactccttcagatggaaggtcacatcagctagaaacattaatatgactggatgggctcaaaccactgactttttcagtcaacatccgacagcactaacccagtgttccagagacactgcttgttaaacagtg

SEQ ID NO: 259778 - DNA, 747 bp, Homo sapiens
ctctgaataaaatatacaagttataacaatgtagcaattgacccagcaaatgaggacacaaacgtgttggagggtgtctacagagaaatagacaagcgatgcacgacagatacatgtgtcagtctggtccctgcagttgtatttgtaataatacacattggagcaatttcatggccatcagttagagaatgtttgaggaatgatccattcatatcaagaaggacatttcaaagatcaaagcctgatggaaatgctggagaccatggcgctgataggagctcatgcgtgttgaccaattactacatgacaggcattggctccaggcttttcctgcactgctcatttaaacactggacaacctaagtgttctgatttagcccattggacagatagaaatggaggcacagaagattcatgtgtttaacttcaaaccctggcagattaggtttttcatccagagcctgtgcttcaccatagctgtgattcacgttctgtcattttccactttaggaatttccagtattccaaatatgagaagctgagaaaacaaacaacaaactcaaaaccctaaaaaccaggatacgtaagggtagatgtttgttgggtgtggatttaaaatggactttttttgccccaagcaacaaagaggcaccttagaaaatagaacagaaaccggcaagtagaccggacatagcttagagtactgtggccaagcgtaggcactcagtctgatcgaagactcacatg

SEQ ID NO: 259779 - DNA, 389 bp, Homo sapiens
gctttgttagaatttaagtttgagtatgctgggaccaggtcttggagctgatacaggactgaagagttttaactttacatcataaatcttattctaagttttcatttgaacctggttttagtttcttaactttgtaagcgtcttttggatatttcagtgtttcatttgttgctctcaaattttggtattcaacagactcgtttctttttcttttcagttaacattagagtctaatttacaatttttagttcatgtcaaaaaaaagttcaggccgggtgtggtggctcacacctgtcatcccaactctttgggagtccaaggcgggcagatcataaggtcaggagatcgagaccatcctggccaacatggtgaaacccagtctctaattt

SEQ ID NO: 259780 - DNA, 698 bp, Homo sapiens
ggttgaagcctccatttccctgtctaggagcttctgtttacactccaccccactctagattgcaagccccttgaataatttttgtttcctagtaccaagaataatggtgacaaatattaggggatgactcctaaaaatggattaagaagctatttagggggaaaatgcccattttgtggttttaaaagatgctacaattgccataaaatgcccaagtttcattgcagaaatcaaatactggagttgtgttttgcttggtcaagaggaaagaatgtacatttagagacaaagaatcgctgtggcagttaactttggtgttacattctgttttcttcctaagcaattctttagtcctctacctcaacggtgcctctgaagaaaggacttacgtggccaatgggatcaccgtgtatttatttcccttccctatcagccatagccctcagggctggaagggcctcattttagtctattcccagactgggtcacccacagtgttgacacacagcatcaaccgacagtgagcttatctggaaaataatgcctttctattttctttgtttcttagcatatattaaatgtttctttccttctctaataatcttttagataaagaaatcatttgctgagctgataataacaaaagtatcctacctacatttttaaatgtcagcagtgaaagacgttttaagggcttt

SEQ ID NO: 259781 - DNA, 358 bp, Homo sapiens
agggggaaattatcacagaattgtcaacagatgagtatcaataagtccatggcccaaaccagccccaaggatgacaagtttcaggtcttgctaggctggtggccttcagaagatgagctttaccttgggtcaccatctgaaaatgttacaaactctattttcccttcatcctgactttgttttcctgagagttaatttgggagacagaatctccaaaaactcattttgctgagaacagcaggtgaaggtagccaacctctcttgttgggagcccaagacaggaggtacagaagaaacacacttggctgttaccaacttgcatggggtcatctcagtccaagtccacccctccacagtc

SEQ ID NO: 259782 - DNA, 403 bp, Homo sapiens
ccactccctgggggactaagcagagattattagactctaacttccagaaaaagggctaagtcttaaacatatctaagattattactatagaaatgttattgcttaattttaatgagtatgttgaccatttaagttgacagtccttgtcacaatttatcaaagacaaattagcatagttagagtcaccaaaaggaaactattaaaacctaagtgttttcacttcttctgatctggcacttttcctatagaactatatatcactttagtgcttcttaattaaaagtgatgtcttcctccaacttagatctgtactgcaaacattccctgtcccatgttgcttttgatttacaaagtacaatataaaactggattatattatcttcaaataaaatcaacaccagtg

SEQ ID NO: 259783 - DNA, 250 bp, Homo sapiens
gagtgaggccagagtagagacaggaatactttttatctggcttctgctgtgagtctcagctgtcttcattttttcccaaaaggttagaaccttcagaaattggcaccttctaggccctggcactgtctcttccttggctattttagaggttacaaaccagtctttaggcataatttagcacagaattttccaaacagcattgtgaagaacactgtatactgcaatatgatgatggttctgtggatttaaa

SEQ ID NO: 259784 - DNA, 415 bp, Homo sapiens
gcaggaccttgaaggctgtggaaggagtttggatttatggtctagcactggggaggtggagaaggtcttgacgtgctctgacttgtcccagttctcatcctccactctttggctggttaagagaaaaactttaggcaaattaaacttagcagagtctatttgagcaaagaaacaattcatgaattgggcagcacacggaaccaggaaaggttcagagagctccacccagcaatgtgatcaggcactatttatccatagggaaaggaactgaggtacagaaacagcctgattggttacagctctgtgtttgccttatctgagcatgtctgggcagcttgtagcctgtgactggctgaagcttggctgccctgattgtccaaggttacttgttacaagaatatactctcaagttaca

SEQ ID NO: 259785 - DNA, 495 bp, Homo sapiens
gggtggggagttgatcaaatttctcaatcttttcttttctggcttaaagattttgtgtcagaattaaaaaggtcctttctgaatcagagattatttaataattctcccagttttttctgttacttttaaggtttcatttttttcatgtgtaaattttccatccatacgaaatttactttgtaaatgtgagtggttggaatccagctttctctttcagatgataatacacttctcccactgatttcaaatgccactttattacgtaataatatggcatctattttctggacttcctaggtagttccatccctctattcatgaactaatgccacattataatatgttttaatacatgggaaactttattgttttatttttcagtattttcctgggttttcttgattgcttaatatctatactactattttaaataattttctattttcaaaaattatatactcacatagttcaaaataaaaataaatcaaaatgaga

SEQ ID NO: 259786 - DNA, 653 bp, Homo sapiens
tcctaaaaaaaaaaaaaaaggaaagaaaaggcacgaataaccaatatgagtttttagagaagttatattgctacaaattatataatattaaatggatcataaaaaaacagtgtaaacaattttatgcccacaattttgacaatttaaataaaatagaaaagttcccttcataattaattctggaagaaacagataactctaacagatctatctatctgtctgtcggtctgtctatctatctacataaatttgaaaaatcaatgtgtacctttttaccaaacaaatgaacaagcaaaaaacttcaaattttattgttgagtttattttaataatttgagattggtttattaaatacataattaaactaaagaaccaaaatatcactccatgaagagaacaaaatttggctcatatagttgattagtggtaaaatatcttcaaattggtttggaattttttagtagaaacacatatggatattttacacaaataattttggatacgtttgcttattttgccactgtttacacgtaaacagtacataaaatgctcttttgatttaggaaattctaatattagataccacagaatttaaatttctcttttttttctattgattatttttccaccagacttctttgtttgaacttgtg

SEQ ID NO: 259787 - DNA, 382 bp, Homo sapiens
acttcccagcaaaatgtcctcttcttcctacaaacaggctgtttctatatgtgcatgtttcatgctaagcacttctttcttgggtggagatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagcgtgggtgacagaaaatgaaagtctttttggtgattgtttaagcaagatgtgtataaagaaataaatagtttttctttcactgaaaag

SEQ ID NO: 259788 - DNA, 1297 bp, Homo sapiens
gccaggagcaattgtggctgcagagggaggggaggacagggggtggatagaaggagactccaagctgaatagccagaaagaaataaatgctttagaattctcacgctaagcaagtagggttaatttctgctggtggtttctactctgtggtgctcttttgttgtttcagtaaccagaacacatgatgttttaaagaaggcaaggactaacttagaggtgaaatccctaagggctctgccgtgtactccagccttgtgacccttgccttccaggaaccatgcaagaagcgcagccaccagaagtccttaaaacagcaggaaaggtgagcctgtcccccttttgtgcagctacctatctgctgaggagcatctgggcctcattcctccaagtccactggagggtccagaagagggagtcagagatgtatcctggtggagctgggagaaaggcagaaagcctttctgacagctatggaataccgttagccaaggtccacttggcccagcactaagcaaaagatgcgtagtttgcacagaaggttttgtgatactgcctctcaacagccccagcagcttgggaactagcaagagcacatttcttgcctcatcagctgtcctgagatggaaaactcagtggatataggaccctgattccgatgaaaggggcacgtggtcccaatgctggagctcctctggcaggttctaaaagcacactacggagcagcggtgccctgccggacactgctggcgggggctcagtgagcactactcacagatccacacctgaccctgttgggtcgagtcaggctgggctttggtctgcactgtagcacctgtgttctttgagttcacatcatgaatgtggtgatttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccacatattgaaggccaacataactggtggacagcgtgggtgacagaaaatgaaagtctttttggtgattgtttaagcaagatgtgtataaagaaataaatagtttttctttcactgaaaag

SEQ ID NO: 259789 - DNA, 575 bp, Homo sapiens
aagaggaaagagcaagtaccagactggtgacttcatctttgaggagatgacccaaaagttgcacaaaagcactttcactcttatcatattatactgaaatcacatggccatacctagctgtaaaaaaggctgagaaataaagtctccagttgagtgtccaagtggctggctaactaaatatcaaggatgggagatatatggggttgattcctttactaaaaggtaaaagggatgactgaattcagggagaaaattactagattctgttatataatatgaacaaaatcctaggaagaaccaaataggcggtagtccattgggtcaggaaaagcttgaccaagtatctgagctatgttttgagagatgaataaaattccactgcaaaatgaagggcaataagtataacagtagttggaaaggtgcctggcagagcaggagccatagattcatctctatatgcctaatactttgcatagtaatgggcaaaataataagcattcaacaaacatttgctgaagtaatgaatgaaactggcttttgcttaagtgaataatcacattatttgtaaactaagg

SEQ ID NO: 259790 - DNA, 464 bp, Homo sapiens
aatcctgcactgaatcaaacagattttgtattaccagatctaggctgactcactgtgtggtcaggaccttgggtcaatcacttcacctggtgactcactccctacctgtaaggtgtggaggacagctggagtcactgtggcacctgtgtgtttagcagtgtgtttgcttgttcctgcttttatgtctctggctggtctaagatggaatgataaaaaaataacggaatgcactttgtaaacgagagcatcctagacacatgtaaagattggaaaattagaaagctgtctctactgtagttacttctcagatatgaccaaccattattaagaattcattggctaatagggctacattttctcatgatcattcttctgttttagaagtgggcaactgcagttttaagaataaatgtgtaaatgtgtgttttcatgagagacaataaagctgttttcattaagaatga

SEQ ID NO: 259791 - DNA, 578 bp, Homo sapiens
cccccagaaggaatgcagcccctctgacaccttgactttagccttaatagacctagttgggcttctggcccccagaactgtaagatggtagatttgtggtgtttgaagccactaaatgtagggtactttgttgtagcaacaacaaaaaatgaacatgaaactgggacctcatgttacagttgctcacgcctgtaatcccagaactttaggaggctgaggtaggaggatcgcttaagcccaggagtttaagaccagcctgggcaacataatgagacctcatgtctaaaaaaaattttttttaaaggccaggtgcagtggctcacattcgtaatcccagcactttgggaggccgaggagggtggatcacgaggtcagaagttcaagaccagcctagccaagatggtgaaactccatctctactaaaaatacaaacattagccaggtgtggtggtgggtacctgtaatcccagctactcgggaggctgaggcagagaatcacttgaacccaaaaggcagacattgcagtgagccaagatcacacccttacacttcagcctgggtgaccaagactccgtctc

SEQ ID NO: 259792 - DNA, 423 bp, Homo sapiens
ataatatatgtgggaagtacttttcctagtgtctgtcacatagtaggtgctcaaaatacattatagctttaattattcaagttttctggggcagtttccatttcaaatattctgttgtgtttttagactatttgttctcatttgaaattctaaaatgtcatcactgtatttttcttcagcatttgaaggaggagggtttgttttttcaggtataaagacacaaaactgcctccactttctacacttgatttgaaaatctcaatcctagtcagagacatcttattaagacccaaagcataggatggctactataaataaacagaaaataaagagtattggtgaggatgtagagaaaattgaactcttgtatacagttggtgggaatgtaaaacggttcaaccactgtgggaaacagtatggcag

SEQ ID NO: 259793 - DNA, 169 bp, Homo sapiens
gtctattaggaagaaaaatgtgtttaaagttttacaggaacgtggagctcatgttcttctgatatgtagactttgataaagaagcatactgtaatgttttatgaactgaaattttaatcaaaagaggtcattttagaataacaagtattattcttttttagtagaggga

SEQ ID NO: 259794 - DNA, 307 bp, Homo sapiens
cacagcaatggaaacagtcaacagagtaaagagataacctatggaataagagaaatatttgcaacccatatatctgataaggggctaatattcaaaatatataaggaactcaaacacttattagtaagtaaagaaataacctgattaaaaaatgaacaaaggacatgaaaggatatttcttaaaagatgacataaaaatggccaacaattatatttctgaatgcctaaatcactaatcatcaggaaaatgcaagtgaaaattgcaatgagatatcacctcacatctgttagaatgtgtattaccaaa

SEQ ID NO: 259795 - DNA, 481 bp, Homo sapiens
agcattccttgacttgcagacatcttcccagtctcccttccatcttcacatgggcttctcagctgtgtggtccctgtatgtcctgtctctttattaggccaccctcagtgaatttagaattcactctaacaaagtatgatctcacgttgatccttaacgcatgacatctgcaaagatctatttccacgtgacagtgagtggcctccctgagagcaggactgtgccatcctcatgctgtgtccccagtgactagctcagtcctccgcagacaggaagctccaagcaaacgtctagtaaataagtgaatgaatgagtgatcagaatgcactcttctttgttggtgccatcccttaagcccttctaagtgtgacttgttttgactcaatggcaagtccattgacttaaataccttgaccagttctctcatcctaaagtgtctgggagtgtacaaaagcaaaaagagaacaccaagttgcttagt

SEQ ID NO: 259796 - DNA, 743 bp, Homo sapiens
atttgttgtatttaaaaaatcagcatctttggttttctactttaatcttacataattttctagttacttcttgttaacattatcaagcacaatttgacactcaaaattttttgatgcctaactacctttgtgttccaggacttacctaccccctaccttgtgttgggaatagagcttttcatcgtttttttattctcccactgttaaaaattgtcatgatacacacatgacagtttacatggtacatacaccctcaattggtctatatctcctaagctttttcatcgtttcgcattccttcatgaagctattaactgctgttggcaaggattcagaaatgagcaaagtcagcaacattaattaatataccattaatatagagggttaacctgaagttattgagagtttttaaaaatgaataaagaaaagggagcttaaaaatctgactggtggccgggtgcagtggctcacacctgtaatcttagcactttgggaggctgaggcgggtggatcatgaggtcaggagatcgagaccatcctggctaacatggtgaaaccctgtctctactaaaaatacaaaaaaaaaaaaaaattagccaggcatggtggcaggctcctgtagtcccagctactcgggaggctgaggcaggagaatggcatgaacccaggaggcggaggttgcagtgagcccagtgagccactgcactccagcctgggcaacagagtgagactccatctcaaaa

SEQ ID NO: 259797 - DNA, 539 bp, Homo sapiens
cacctctgattaaaatcaatagctgaaacaccatttgtagtgggaatatagtaatatataaccaccaaactctataaacagcaatcttttatttgccccaaattctatttggatttaataaactaatgacttcacaaacatacatgaaatgacctaaccaatatcatcttcatatttctttatctaaaccctggaatcttaaaacagaaggctcccattatgttaatacagagattcaatagtcttttattgaagactattagagactaaatgtttgtgtcccccaaaactcatatgttgaaacctgatccccattgtgagtatatttggaggttgggcctttgaaagattattagattatgggggcagatacgccattaatgacattagtccctttataaaagaaaccccacagagctcttttgccatctatgaaccaggaagcaggacctcaccagacactgaataggctgatgccttgatcttggactttccagccttcagaactgtaggaaataaatttctgatgtttataaaat

SEQ ID NO: 259798 - DNA, 322 bp, Homo sapiens
ttttatagagttgcagtaagtggattatcttcgcttataaatgggttgttagccatgaaactattcttttaagatgtggtaacacagtgtggtaaatagaagattgcatggttctgtaaatgctgaaaactgctcataagtggggtgcaagcacagccccatatggacttgttagaagggagtacttccagtaggaaaagctttgcaggtgacaatcagaataaatggtacaggattttgttactgtaagccatccaacctagtatactcatatctcacctcagtatacctcactcagttctccccaagtgccagatcttta

SEQ ID NO: 259799 - DNA, 284 bp, Homo sapiens
tgcgctccagcctgggcgacagaacgagactccgtatcagaaaaaaaaaaaaaaaaaaaagttatgttctctcaggggaaagagatctggcttcagctaaggagagatagccaggttggcctactacatggagaaggtcttattcataataatcaaaaaaataaatccactcgccatgcacgctgtttcatagctgtaatcccagcactttgtgaggctgaggcaggcggatcacctgaggtcaggagttcaagaccagcctgaccaacatggcgaaatgtcat

SEQ ID NO: 259800 - DNA, 548 bp, Homo sapiens
ccatactgcatttcagcttggagtgcgcagcatgaggcatttgtggttcagaaaagaggtcttcctttttcctcctcctgttttcttttccttccttctccccaactccccaaaggcttactgcctttcttctcaggccacgtgtgtagataacctttgaggaaaagatggtttccgtgctgggatatttggatattacctaaagggacaagatgagccctttctttgccttgttttctttctctggcctcatcagagtgaattatatctgactgtgtgacagttaattgtaccatccatcccgtgtcctaagctgataagcccctctctgtctgcctccatcaagcttctttgtttgagaagttcctaatgcagtaggagaacaaagtgacagttttcttatttactgaagtctctaaagcacattcataatgctcttcattgtatctttcttataacttcattccttcaacttaggtaattaaattgttccatagtaccagtgattgataagttaaaacttcctcagaaacatcagtgagttcagg

SEQ ID NO: 259801 - DNA, 736 bp, Homo sapiens
attccaggagaagagattgttaatattgataggggttgtggggtagagcaaatacgtgggtctgtatatggtcaattgtatatggtattttctaaattgggtactgaatatattctgttgactaccatgaagttgttgcataataaggctgactagtggcacttcaggttagaaagtatagttatattattaatcggaagctagaccaattttaatgaatgctttctgtgatgcttctgtgctttcatagtgtagattgctgctaaaatagtttcatatcagtgaaattcttctatcgtaagttttcatgagatcacaggaaaagaattgccacatctaatgacagtagccactaggtacatgtggatattgagcacttgcaatggggttagttggaattgaactatcttttcagtgtaaaacacatactgagttttgaagacttcataccaaaaaaaagaaagctaaaatatttaactgaaagtttttatattaactgcatattgaaataatatttttgatatatttggataaataagatactatcattgaaattaacttcacctgttttttacctttttaatgttattagaaaagtataaattacatatgtggcttgcattacagttctgtttgacatagttgctctaaagcttccatttacttttttaatagtaattaaattttctatcatacacatagatttaagaaaaatcttaccccttcctcccaaagt

SEQ ID NO: 259802 - DNA, 834 bp, Homo sapiens
caaacacctgcatcctgtttaattcttcagtttaaatttaccaacaaacataaaaggtaggagattgggctgctttcagggcattgagctcaaaagacagaaagaggcaatttatgtgtcacttaatgtttatcttacgcttgcctaccgggaagagtgaaaagatgttaaagaaaaagagggaatcttttcattccttgaactgttgtgttgaataaattttaaagaaaaagaagcaaaatgaaataacttgagaacaagaacctaaccgcatatgaacataatttacatgccataaaataccattttcaatgtacaattaaatgatttttataaaatttacataagccatattttttaaagtattaaaagacagttatgagctaagcttttaagtacagtgatgattgagagtgtgataaaaatactgcaggtagcatttaattagggaaattcctgccagttgaaagatgtggatggggattggcagagattgaaggaacagccattttgtgccagacactctgctggaagaggagcagataaacgggcgagtctgggagcattttaagcagcatttaaaggataataaggtcctgtcttcactaagccattgacatgaatgtgatacttttatatttgtttctgttttctgactttagccctaggaaaataaagggtcatactagcattgcagttattttctcacataaaaaattatatttggctgcttctaattggaagtatctattttaagctcaactaaccctaacatctcaggtaactgtggacagaacttcacatattataagcgtcttactctgtaaaaaaaaa

SEQ ID NO: 259803 - DNA, 994 bp, Homo sapiens
agtttattactttgcctttaacactgttgcagtttacatttatttccttgtttctctcaccatatagaagggatgaagttggggagaacctggtatttagttcagtcctggatgagtgccagcagaagtttgaaaggatgtcatgcatgtgtgagatttagctttccagatattcattgcattgttggctcacctctgccggtggtattgctagcattgcacattggaactgcagcttgggaaagtgatagaaaccaaacacatggtgggtacaaagcaagtttgttgtattttatccacattagtattttggatgtttcaatatttaaacatttcaaaaagcaaaatcaatgataatacttcttgaatgtgttgtgaacaatgcaagccttttattaaaaattatggaatattcgaaagaaatgtttttcttacaagagagcagagaataattactcagggttcctgtgtcaaagcctctagggcccctttactgtccagaattcttagtaagggaccagtttcatgggtcttgttgccaaagcttacttttttgatcctactgctaaattctgacccttcctccaattgatctgctttccaaaaagagcataccaacacctgcacaaaccatttgatgtggtgcagtaagctgtttcatccaagtgttccaaagccataggatgagcaagggggaaaaacttagacctgtataggatcttcccccaggtagttactctttcacagggggtgcatgggagacaggctgctgttgtgccatcctttccattacataatgataacaactgttacttggaatgctttaatgcttgatgttatttatgtttaaatatttgctgtattcctggctctgtgctaaatgctatgcctgcatcttaaaaaatccttaaaataactcaaggtaggtaccattgttgcttccattctccagatgggacactaagactttaagaagttaaatagctcacctgaa

SEQ ID NO: 259804 - DNA, 329 bp, Homo sapiens
ccctgtctcaaaaaaaaaaaaaaaaaatccacattcctggagacttgcagctaaggccttccacaataagatgctgcatttacgtttcccacccataatcaactgctatcccaaacatattgaatatctgtggagaagtatgggtgggtgcaatatgtcactcctagcagaatcactgaggaaactgaccacactcatgatggaaaattgacggtaatgagtccttccctcaggttccccaaccccacaatatgccctaaccatggtggacatgtattcctgtctgtcactggctcacttctcccaccaggctaccgcaaactccacct

SEQ ID NO: 259805 - DNA, 638 bp, Homo sapiens
ctccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaacttta

SEQ ID NO: 259806 - DNA, 490 bp, Homo sapiens
tgatctttaaaaacaaacactttccaattgctttggttactgagccccatgcactgagttgtctaacacgattgtgaaaaattcctgggtatgtgtcttagggctgtggtagaaagagacaacaggtcacctgccaggttgtaggtccctgcttggagaggagtcatttttcaccccaggatggtacttctagcccaagcattccatcttacagtggaagagatcaagtccctctccatttatgtatgggctccataaaaggcaatgtaacttgttaccacgctgtattggtaggaaaacaaactcttgactctcagttttgattggaagagtgctggatgaaatctttcccaaggctacttgacttgacctcatgtaattgtcttcattgttagcaacagaaatgtggatagaactacctagaattgcttttggttttgttttgttttgttttgttttttacaataaactcaatgtgatctaacaatta

SEQ ID NO: 259807 - DNA, 611 bp, Homo sapiens
aaaatatgcaaataacttctagaagctgagaataactccctgctgacaacaagcaagaaaaaagacagaacagaccttcagctttaagaactcgattttgccaacaaatggagtgagattggaagtagattcgttctcagattctttagataggaaacctacccagtgaatacttcgatttgaccttgtaaggtcttaaaacagaactcaatcaagtcctccagacagacgtttgacttacagatctgtgagctaatacatgagtgtgttttaagctgcttatgtatagtaatttattacatagcaatagcactaaaaaaactaatacagaacccttgcacatccagttattctctgtgtttctgctgttccactccatgcaaaagtggtgttatgacatccagttggtgctcataatataaatatggtgagtgtcccttcatcatgtccatacacactggccagagccctcttttatacagtcaaagtttggacagctttcttgggtacccaaaatctgagcaagagaacctaaaaaattctttcattttatggtaaacacatatatattggcccagaaatttcacaggtcaaacaagctgttcttgtct

SEQ ID NO: 259808 - DNA, 676 bp, Homo sapiens
ttccagtcagcgcggaggcggtattgagttcagccgctccccacagccccggagcccctgggcggtggcggtggccgcggcagcaccggctcgacagccgatagggtcctgggcccgctccgctcggggtggtcggtgggcggagcgtcgggctcggtcagaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccagatgcctccacctttttttgctagtattgtgtcaaataagacaagttttttcaaataaaaacaaatctggacttagtaagcagagactttattcaaaataattattgcaagagaaaaaagggactattgaaattggaagaggaggaggactattgcaatggaaagaatg

SEQ ID NO: 259809 - DNA, 564 bp, Homo sapiens
tggatttctcaaaccacaaaaggtaaagttaaggaattggatgatctgtgatttatagtctactaactgctttttctagtgtttgcccacatatctgtgttggtgaaatgttgtgtatcataccccaagtcagtgttacattgaagagataacttcaggtaggtaaatataattgcttaagtgttctaaacaagcgtatgatttcttctttctctttttttggcaggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatggagtcttgctgtgtcacccaggctggagtgcagtggctcaatctcagctcacttcccag

SEQ ID NO: 259810 - DNA, 451 bp, Homo sapiens
aatacacatctcatcaaggcagcaaatcaaattgcctttttgaaacaacttaaaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatgctgtttagagaaatgctgattgcatgtctgtgaaaggaaatgtaaagtaagcctggaacatcttgtcttccggagataaggaaactattaataaaaaagactactatcagggattcatcagaaggactcaagagcctactggaagagtctcccaccttttcctataaaagatgagaaaattagagcatcaataagtataataatttcagggaattaaactgcatcaaatatatt

SEQ ID NO: 259811 - DNA, 671 bp, Homo sapiens
aggctgcagagctagagcagcgccgcccgaggggcggcaggggctgaccacagagagcgcgggggcctccagccgagaggaagggagggcagctcgggccgaagtcgttggcttcgtaagagcagggtctatgggaagcctcctcagcgtgggttcttggaagaggtggagtttggagaggcttatgcggtacctgattcatccagcaaattaagacctgccaactttttgataatctcgtcaataaattacagaacaattgttcctttcaagatttattcaaaacgtgtcaactctgcttaattaagcactttgatgatttaagaaatcttggaaatccttttgtactattgctcattcatacttgttcatcaaagcctggagtccttaaggacagaatttacctctaaacagaaagatggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatggagtcttgctgtgtcacccaggctggagtgcagtggctcaatctcagctcacttcccag

SEQ ID NO: 259812 - DNA, 586 bp, Homo sapiens
ggcctgccaatggagcagcgttcacagactgcaggttaagggaggcacccagggtgctatgcctgtgagcacacatagtctgtcatggactctgcccccaagcatgtcttggagctacttatggataaatccaagtgactcctctcctgtatttaatattccttactataaataaatgtttgtctaaaaataaagttaatacagatatcaattgttaagaagcagtgccatctctggagtggagtgggacaggagaggtactggctcagtccacgtgtttgtcacacatatcagaataatttggcctcagaaaggcctattaaggccattcattagatggactcagcccaaatgttgtcccagtgtgagattagacgttggattttaagtaccttaaaaagaatgataaatggctgggcgcagtggctcatgcctgtaactccagcactttgggaggctgaggcaggatggtcgattgagcccaggagtttgagaccagcgtaggcaacatagtgagaccttgtctctacaaagtgtaccctacactcacaggctggaccctgccttactctcacgtggtgtcaca

SEQ ID NO: 259813 - DNA, 293 bp, Homo sapiens
agtgggcaaaggacatgaacagacacttctcatattttctacttaccttatctgatcttctccattgactggcctttaatcactaaaatttaaaacaaacaaaaatcatagtttcttctttatttcatgttggcttctcagatacatcacttcctactcaaagtatctgttgaatgtttattatgagctaatgcgttatccattgagttggcaatctggaacaaaatggggaagatctgtgccctcactgaatttatgaatgcagaagagaccataagccaatacatataaat

SEQ ID NO: 259814 - DNA, 575 bp, Homo sapiens
cagggccccatgcagggagaggaagttgtggggaaaggcagaataacaagcagagaaactaattttttaaaaaggtttttaaaatgttgtgggtgaaataaaacacgagctatcagttaatctgtataaccaatgccaagtttcattacctctcttgtccaacttcctcatcaagaaaatgagcatagccacatctttttttgccttaaggggagaggcagaattctaacaatcataagacatgattcctgatgtgtgcgtgatccccactgaatctgagagtcaagcactgttgcctcggtcatacaacatgtatgtgttgatcctgactttgcaccaggtcctattctcaccccagtggagaagttaaggctcagagagttaaggagtttgcctaaggtcacacagcacagaagagtcagtaaattcatttgctggcgggacacggtggctcactcctgtaatcccagtactttgggaggccaaggtgggaggatggcttgagcccaggggttcaagaccagcatgggcaaaatagcaagaccctatctctacacaaataattttttttactt

SEQ ID NO: 259815 - DNA, 480 bp, Homo sapiens
tagggtgtgagtttccctaagattttcagggttttatatattatgacttcattttattgcaaattattttagggtggtatgacataaaaatatattgattgattgattgattgattgattgattgtgggtatatagtttactcagtatcaagttcaaaaagaccatacattctgcattattattattgggatcctcattaaagattagttggtcttatatacattaatttattctgagactctttattctgtgccattaattttgtgtcagtttttatgcacatttttatataacttagccttgaaatatagttttgaattggaaactatgatgctctagtcttagctttttcttaaaatttcattggttatttaaagtcttttgtagtttttatacaaattttagaattgtgttttctattactgtaaaaatatcattgaaatatttatagatggtgcattaaatctataaatcattca

SEQ ID NO: 259816 - DNA, 416 bp, Homo sapiens
cggcacgaggaccattctgatgttgggatcacaggggtgtgattcttagtgtgttccttatttttatgactagaggctggtgtgcagagcagcactgtgaccagctctggctgtgcgatgagggcttggccattcctcggagtgctttcaggtgcctgctgcttgagctacctgaatggccaggaacctgagctcagcactctccgagatgttgcacatgtaactctcctggaagctaaggtgttctctgaaataaaactaaaacgataaaatacacattgcccacacatgcacaccctggtcagcagaatttacggctgtcttgtgtccaaataacataaggcagctccagaagttggaaacagaattctctgctgagactgaaactagaaagagctggcacccaaaaaaaaaaa

SEQ ID NO: 259817 - DNA, 355 bp, Homo sapiens
gtagagattcattaaagcgcctctggtttgaggggcgtttggagatagcttggtacctcccctccttgtcctgctcccttcagaattttttaagtccaatttccagatcttacctagtctctactcctaggactgtttgcagtgagttagaagggtatttatgctcttactgatagtaggttattttcaaaatccatggctttatgattttttaggcactagtcattgccgcagattgcagctgaggaccgactattcagtatctgttttcgtaactgttggcactttatatcgtagggaagggagttgttaatatggtttgtcttttcttataaaaaataaaattctatatcca

SEQ ID NO: 259818 - DNA, 446 bp, Homo sapiens
aattatataaaaatacatcaaggagtgccctgcatctatgttctcctagtctttgaaggcaaattctctatgaatagaacttatagagattctaattggtcttacaattgagtttccggtaattgaacataccttttagtcttctttacttcatatcatcatttcacatcttcttcatttcaattactggtgctagaaaataaaacgcaatacactgtgattcgtgtgtagaatgctggttagttcagctccaaagagcaagtaagatgttctatgctcagctctctcctgggtctgctcataataggtattcagtaaatagttgttgaatgattaaataaatgaatgagcaaatggatacaaggatgctgctatgtagcattatgtaacttgcttagattgtatgtattttttactgtctgtctcccctcaatgggatgacggcc

SEQ ID NO: 259819 - DNA, 685 bp, Homo sapiens
ctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccaggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaa

SEQ ID NO: 259820 - DNA, 897 bp, Homo sapiens
ctgggattacaggcgtgagccactgtgcctggcctcttatacatatttttatgcactagtaagtattaaaaataattaggatatatgacattactcattgatgagtgacacttcccttaaaatatatcacattttcccatgtcattaaatactaactatagtattccatagtataaatgcaccatagtttgtctaacaagttctctaacactatgtatttggtaattgctaatttttcctttttttgagactccatctctgaagaaaaaaaggaaaatcttcctcacaaaaggttagataaatattcacttttattattttttattgacttctttatttttttattcagacaggatcttggctctatcgcccaggctgcagtgcagtgggacgatcatggctcactggagcctcaacctcttgggctcaagtgatcctccagccccagccttcagaggagctgggactacaggcacgcatgaccacctgctaaaatatctcacttttgttttctcctacatatttgatgattttttttggttttcattttatgcatttagtgctttaatatgtctgcaatttattttggtttatcatgtgaggagaggattggattcttgtttttcagcttgtccctgcaagtttattgaataatatagttttttcctactgattttaagatttttgaatttagctgaaaggttttatcttctagagacctctcttgagattaatttccactccactgatttctctatttttctacctttatcacaatatttaaataatacagtcttatatctagtattgcaagtccttcagtagttttcctttccaaaattttctttgtcattcttgactattcgttcatattattctgaattacattattaagtt

SEQ ID NO: 259821 - DNA, 403 bp, Homo sapiens
  misc_feature (387)..(387): n is a, c, g, or t
  misc_feature (394)..(394): n is a, c, g, or t
  misc_feature (396)..(397): n is a, c, g, or t
  misc_feature (400)..(400): n is a, c, g, or t
aatgttcagttcgagtcatcagctgtccctttgggtcttttatcactgcttttgtcaagctatctatttaattgaaagaagttaattgaatgaaaatgatcaactaagcttgtattaatattgctaatggaactttcttcttggccatgtttggagaaagatgtcaagctagactttaggaagggcccattaatgcttgcacttaacctgatgggctaattaaggaatgcttattcatcctccaagtccacgaagtctctctccagcccgttctgcctggttttacaacacatttctcttaggagcatgagcattagcagcacagccgtaactgataatgttttgattgcactgaatacagtcctaatgcatcgttatttataattnggcaatntnnaanatt

SEQ ID NO: 259822 - DNA, 535 bp, Homo sapiens
actgatagaaccaaaattctgccctgacaagatagtcctacaagtgaatagaatgtcctaatacccttcacccttgtgcatgttgagcccaaactgtaggcagggagagatcagggaggctcagtacatctcaagactccttcctcactaagtgaggacgggtaggtgaggagatgtggactgcttcagaatggcacccggttaaaccaggccctgagtaattcattcataacaattcttcactggtcacctactgtgcacctaacatcattcttgtgtggagagggatacacactaaatacacacacagacaaatggcgaattataatacctatgaagaagagcagggcaggataacagggaggagagggatgggatactttggtggcccttccctataggctggtgaggtgacatctgaagaaagaacttcgtgaaacgaagtgaactgtatctggggcgcttatggaaaacaaaccctctagcagactcactggttgtttttataaataaaatgtagaagctgggccagcaa

SEQ ID NO: 259823 - DNA, 307 bp, Homo sapiens
cctcagtgaattctttctggtctgtttttaggcccagcctttcacccaagttttctaactttcttcaggtcagttctgcttaatccaggagttcttaactttttctttctttccttgttgttgtttgagaggcagggtctccctctgtcatccaggctagagtgcagtcgcatggtcacagctctgtgcagcctcaacctcaggcttaaactattctcccaccttaacctcccagagtgctgggattacaggtgtgagccactgtgcccagcattcttaacctcttactaatacagtattagttggt

SEQ ID NO: 259824 - DNA, 289 bp, Homo sapiens
aggatcctctcacacgccgaaatccctagcaacaacttcgtccatcctgatctgtatgtatgggctctcggcgtgtgcatgcacacgccgaatatccacacacacgccgaatcaccatacccgagcgcccatactatattctaagtgggaccaaaagaagattaacttccaggtggagtgacagccatgtgaatcatccacgcctttttcccacaccactcccagcactcattctgcagaagagatggaattcagtatggtttctcggcgtgtgcagggtaccgagctc

SEQ ID NO: 259825 - DNA, 704 bp, Homo sapiens
aggatcctctcacacgccgaaatccctagcaacaacttcgtccatcctgatctgtatgtatgggctctcggcgtgtgcatgcacacgccgaatatccacacacacgccgaatcaccatacccgagcgcccatactatattctaagtgggaccaaaagaagattaacttccaggtggagtgacagccatgtgaatcatccacgcctttttcccacaccactcccagcactcattctgcagaagagatggaattcagtctccttccctagctcctttttcctcaaatgacttttaaatgttggtgacccttagcgttctaatctctttcatctgctcttctcacattacacggtgtcccttgatgattgtacttattccaatagattcagatttgatatatatgccattaactgccatactgacatctcctggtatgatctctctcctaagaatcatacccgtatttccatcttaagcacctcaaactcaccatgcccaagccaaatgcctaactacgtactaagcacccgccttctccttcaattcctttgtcaaaaacagcaccactatttattcagaatccaaaagtaggctgatttttgttatcacaaatcctttcctttcccctccatcacatatgtaggtaatcatctacagataacagtcactgctcagtaaaatcatcaataattctacttcttaaaa

SEQ ID NO: 259826 - DNA, 1272 bp, Homo sapiens
tatgtttccagaaatggattctttggagagaactcggatgactatcagttttggccctgtaagatcgtggagatctgtaagatagatacttatataacttacataaaatatatataatatattacttatataacttatataactagctattattttatataactaactataatatgacaaatcctttgctagtagtactaacaacgttttataggagcacaattaattttacttaggataagtgttgttattattgtttttattgttgttctgttagttactcaaaacttcattctaattgtgccctgagtttgttaaaataccatactgtatttttgtgtaacatgtaaataggcattaatttttgagaaatagaaatgtttatccttaatgtatttttaatttgctaacattgattttttattttctttcctgaaatagcttatttcctaaaatgaaagaatttattctcagatgaataatttttatatcagctattcttatcaggtaaaagtttaattattttttatttataatatatgtaagcaattctcaatgctgctctttaagaaaaataaatatgattatattaataataagctttaagagttgaaaatttaagacaagtcattttgtatactgaagtgaattctttgttatttagtgctgataattgaataatgagtagctcatattaaaaatgatgcaaaaacctggcactaaaattgttagtaattttttttaagtatctgaggctagttttcaagtgcagaaggaacattgacaattactttgttttaatttacattcagattttaaacataaactaggtatgtttatagatctttttgtcttgaatgtatttttttgtaaatagaaagcaatcactttaacttacacattatcacatataacaggttcagttactctcagatatttaacactacttacatatttatcactttccttagaatttttgaatgaattgattcatacaaacacttaggcaatattttaaacttaatgaacagattcttcccaagtgcctaaacaactcttgcaaattaaattaccgttttaaattaaaaaatcaagttctcaagaatttcaagcatcatttggtgtttctttcgtttttgagatagggtctcactttgctgcctaggctggagtacagtggcacaatcccggctcactgcagcctcaagctcccaggctcaggtgatcctcccacctcagcctcctgagtagctggtactacaggcatgcacc

SEQ ID NO: 259827 - DNA, 428 bp, Homo sapiens
cagcgaaagatgtctttaactgctaagctgctttttccaactggcagaagcccttgagaagagtttattaagaatgaaggaaaaaaataatccctgtgtagtttacacaactgttcctaaaattcatcccccacccatgcattaagcagtaccatgtgccgagagccgttctcagcctgggggtacagccctaaacaagtgcccaccgtcccggccctttggaagctgcattccacggggacatctgcagaccacagggaatgatgtacgccttgaaccgaaccagtcagaagaaaaaggaggtggttgactttgagttgagttattttccaacctcaagccttcaacatcacttaccctgtctcataagggaaacctggctgtcctcaaaaccagcattcaagatttaaaataaatgttaaaaacaa

SEQ ID NO: 259828 - DNA, 414 bp, Homo sapiens
cggcgcccgagctttggtgcagcattttggttggggagccggcttcagccacggccccacccctgccttcccctttggtttcggggaggcctgtgcacggcctcacccctggcaacaatgcctgtccccctcccaggagggcctgggcaagacagctccacagcacccctccaggcgggcctgccctcccctcgagaaaacggcctttggatcgagggagacaagctggactttatgacgctaacgggggcggcttgcggggcggggccaagccggggggcctccaggatcacactactcacttcagcaaagaaaccgaggggcaagaattgggtaaggccggccccctgttttttttcctctaacacctgtgtctagtcctcccctccaagagcattaactatttaaaacaag

SEQ ID NO: 259829 - DNA, 473 bp, Homo sapiens
tctctcagtgtagcttgccataccaagatgttcctagagttctttcctgctaccttttcggtcgagcctcccaccccaatcccagcaccatcactgggtgagtgatccaccaccaaaggcagctttggtaatcctagccacacatcaagcctcttaataatggccatcatactcatattccttcgaacctctaaggagacctaaggggaccttgtccttccttctccagttacttgggttaaggcaggcactagtctccctggaacgcctgacctcttaaggagccatggcagaacagcatagctcaaggttgtgcttgctccactcaataggttaaatatgagtaaaagatttgggtcacccccttccctctggaaatttctggctgaagtgaccaaagaatgattttaaggcaaaatgataaacatgaacaaagggcaataaaacagcacaaagaaaatattacaaaattc

SEQ ID NO: 259830 - DNA, 376 bp, Homo sapiens
gctattattagttccaatccgcacaaatctaccagtgctaaagggaagcttctgcgaactttggaaggtggattaactgtttcagagcagcagctgcgggcccagatagttgtcggagccgctagacacagccaagcgcttccctgaaagccaaggccggcggcgagctggtggtcccgccggccggaggcccctccccgccaggccgcagaacccgggtcggagagcagccagtctcaacctgcgtccccaaggccgaggatgtgtcctggttttttaaaaagctgtttgcgcacttccagggcctcacccctttcatttggggctccagtattactgtattgacctaattaattcatttttttctcagtccaaa

SEQ ID NO: 259831 - DNA, 480 bp, Homo sapiens
ttacagttggaaaactaataaatgcagaaggaataacaaatttaaaatatcaccatttggcaactatcacaattaaaattgattcagaaagaatcatcaattctattctaaagttagttggcaaaagcttcatgaggaaatatcttccaaaaattacttattaattacaaagagaaaaacagtaattatacagtggagatacctggcagacaccaacttaatgatcaaggttaatcccacaaggattgggacaaacagacatgatatgtatcatgatttgattaactgaaaagaaacagcatgacttctgtgatattcctgccaaaaatgcatgcccaaaatgcaaaaatgcatctaatcaaggtattcaaggaaatgaggaaaaaattcacatacttaaatctaatcacaaggaaacatcagacaacccaaattgaaagacattctacaaagtaactagctggtataatttgccaaaaa

SEQ ID NO: 259832 - DNA, 671 bp, Homo sapiens
ggggtccatgtaccctgccctttaatggcacaggctctgtgactgctctgaccaatagaatgtggtagaagtgtgctgtgccagtttctgggcccaagcattaagagattggaagcttctatgtcctatagacattcaccttactgtgagaaggctaagccacatagaaagttgtttttaaatgtgggttttattattatttaggtataatgaggctgacagatcaagagatgactaccattcaaagtagtttgtcactcacagatcccaagaggagaggcatgcacgcggggaatcaccagggtcattcaggagagacaagtggggagggggaaacatgggcaggagactttcttgtggttttcgtgagaaaggcaaggcaggattagcaggctgaggattgactagtttgaataacttcagcaggctctgtggtctagggcttatcactgcttgcctggtaattggctttaagatgattaggaaataggaatattgtctactgggacgtaagagccagctagaggaagtagttcagagtatgggctctgaattgcttaattcgcatattaaggcaccctgctggccatgttgtttgctatatctaataattggctagcctacgaggggcgttatctccccaggcaacaaaacaccagattccagtgcat

SEQ ID NO: 259833 - DNA, 434 bp, Homo sapiens
ctctacctcgagtagatgccccagttgaaagcctttatccccaccaattacacattcctttggttcaacaattcccttttagataatgtgaaaacccttaattacttaatcagcccttcacagttaaaacaagaaccataaacatcattattggttatcatgatttgatacaggtaagaaaaaagtagagaagtgaaaaatgaggtgctgcaaattaaaaatgtggatgtggccagggactttggattctagaaagacagccagaaatctctagacaaggaagaggaagagggtttaaaagtgaataaaaggacgctataagaaataattaaacatttggcaatttcttcttggccgatagagccaccgcaaaccatccttcatgttcccttttgttctttggggtgtatgtcacctgcataggggattagttg

SEQ ID NO: 259834 - DNA, 654 bp, Homo sapiens
ataagtctcaactttcttgtaaggtttttacatactaaagattttattattcatctactctgatctatagacaagttgtataataaattattcagccacttcctgatgaatagcagaatgatattatatactagagtctatctgaaaggaatatttctttataggctagaggccagttgactgtcctactctttgaagaagagtgacagttcctgattaaggttatttttcctcaatactagattccaggggagcagaagatatcacagagaggaaatccacagtgatcaaatgggacaacccatcacaggccttatcttcacctccagaacgagtagttctttgttctggggtatgctttggtgtaggaaaacttgaggattacccccacctgcctcaggatgtatccatctgtgaaccaattagggcatgggctatgatctcaccattttatagcagaagaaaagagaaagacctaaattcaaaaagcctgacttttgattgaattcttgcctctggtaaagcctgctcccatatgtgtcaaggataaatgccaagtaagagctcgcattttgtacccaggaacagcttaaatcaaaccctgtttctgctggatcccagaggttttgacagttcatggagagacactctcat

SEQ ID NO: 259835 - DNA, 487 bp, Homo sapiens
ggaatttgagtacgacagctccacatcaggggaactcttcaagtcagcctagggattgtcctgccttggtatggactctttaaaaggtcaacagggaaacacaaaccgtgtgaagccatgtctagatagcacaccgaaaagaagaatatttgctgccaacctatagctatgctgcccttggagggctggaaaatggcttccgcgagtttacgagaagagggaaacactctttgtgattgaaaacacacccgcacccacacacaatttctaagttttcttaacaagataaagacgggataatttaatactcagggaattctttgttaatgattccattcgtcctttattatcatccataatggtttaaaaattatagtctaattggtgtcttatgatttgatcaaattcaacattacgaaatttaatcaataagaaaggtctctgttgttcatgactctaaaaataaacttgatgaaaaatatgagaa

SEQ ID NO: 259836 - DNA, 639 bp, Homo sapiens
aaaatacaaaaattagctaggcatggtggcaggcacctgtaatcccagctacttgggaagctgaggcagtagaattgcttggacccaggaggcagaggttgcagtgggccaagatcatgccacttcactccagcctgggcgacagagtgagactccatcttgaaaaaaataaaaataaaaaataaaaaaaacactggagaagacagactgccaagataaatgcagatggtaaggtgtgatacaagaaaatggaggagtaggattcaaaccaatttctgaacaactacaagcctatgctcttcccatgacaccaagcagaatcgcttctttggagtaaaggaaatatggacgatactatgggtattcattataatacgtgactctcactttctaacggtgtgagcatgtttaccggccttgactgtatgagataatctcaggtcccattcctcaggcaggttttgaagcaccaaagcaacgttactttaaaaactttacttttgcaggacttactgcaagttggctcttgtttcttgaattattcaagtttttgatttttaaaggtagcatgtaatatgtaataccatttccacacacagatcaaatagttgagagggaaaaaaaagccatccaattatg

SEQ ID NO: 259837 - DNA, 161 bp, Homo sapiens
accaagaagaaatggtttaaatcacaatttcttggccctattgacattttgagccagacacttctttgctttgagggactatcctgtgcattgatgtttagcagtatccttaacctctgtgcactagatgccagtagtataacctttctaatctgagcacc

SEQ ID NO: 259838 - DNA, 427 bp, Homo sapiens
gctatatcattttgcattcccaccaacaatgagagtccctgttgctccaaatcctctaccagaatttggtattcatgttttggatttcagcattctaataggtgtgtagtggtatctaattgttgttttaatttgcacttccctgatgacatatgtttatttgccatgtgtataccttcttcgatgagatgcctgctcagttcttttgctcatgttttaactgggttgctcatttccctattcttgagatttaagagttctttgtatactttgtataaaattcctttaagtgacatgtcttgtgcaaatattttctcccagtcaatgccttgtcttttcattctctttgtagtgtctttgcagatcagaagtttttaattttaatggagtccaggtcatcaattagttttttcatagattgtggctt

SEQ ID NO: 259839 - DNA, 198 bp, Homo sapiens
tttttttttttagagatagggtcttgctctgtttcccaggctagaataaagtggtacaaccagaaaattttcccttttatttataaatatcttaatattgtctttaatccatttgttctgttctcttttttcaggaacactaatttatatctattttctttttcatatgtattatcttcttcataataatttttgtcg

SEQ ID NO: 259840 - DNA, 542 bp, Homo sapiens
ttaaattcaactttttgatgtctataagttttagattagaaaaaactctatatttaggatgacagaattatgttactgaatgatcaaattgggaattagtatcaggattactatatgtcagagctgtctaaataggcttcaaaccaatgggcataaaacattaaataagttcaaagattttgacccagaaattccacttccagaagtttgttctaagaaaataattcaggatttatttatggatttttgtgaaaagattccctctagagtattttttattgtaatgataaaatatgggaaataaatgtttgcaagtatgaggttagctaaatcacttgtattacattcgtataacttacacattaaaaatgatgttttaagcaaaaagcttagaaagattccagatgcccattaataagttcttgttgaatacaaagtaatccattcacacaatggaatgccgtgtcactgtaaaaaggaatgaggaagctctctattataagctgatatggagtaacttccaggatgtattagcaagtaaa

SEQ ID NO: 259841 - DNA, 373 bp, Homo sapiens
actctgaaaacatgactagaaatcctatttcattggtgtatgctcttaaaattcaaaaaaactaaatgcctaattctttcgtgtctatattctcaaaatcttgtcaagccaaggaaggtaaaggagaaagtagtattcagtcatcggtagctttttgtattcaatctttctcattgataaagctttaaaggtcgtacaggtcctcacttcatgacaatgataaaaggaatcacaagagggcaggtttacttggtgagcagaaggattggaagcattttctctcttgacattgtttggaattgccagcccatgataataaaaagcagagttttgatcaatcggttgatttttgagacaggttctcactctgtca

SEQ ID NO: 259842 - DNA, 465 bp, Homo sapiens
tccttgtaacttaataattaaagagcaatcagggcctcccctgattgcttccaccagcataaatatccttggaaaatgtcagtcgagcactgttaacttattttgtcctgagaacctctaatcaaaagagaaagatcttgacacagtctgtggtgggatgttgaatgcaacatcacagaacaaggccagagagtgatttgaaaggagcagctgcagaatcctacaggaaatgccgctacattctggtacctgagagaaggaaagtgaaaggcagaactcttggtggagcgcacaagcatgcccagcactctctgggaagctggccctggagtaataagccaagggtaaaatgaactaaggggctctgaaaagctgggatgcaggaagcaagtcttttcataaggaactgatggaggaaggtgttccttccataaacctctggtttccagatgctttaagagatgc

SEQ ID NO: 259843 - DNA, 474 bp, Homo sapiens
aagcaagttcacttctttaataagtacaaataaacaagactgatgaggtgaacaaaaatcaatccacagattccaaaaattttacaactgtttattttcagttcaaacatgattgatgtcaattagatgcagatctgtcctggtgattctcaggaaatctaccgtgtcagataattaccttccgtgaaactcagaaaatccagtgctatgctttaacctatcttttccccaaatccttaaattccatacattctttaaaattatttaatttttatcactatttttcatttctgctaatattaatattttacttacaaaatacagcaaatacttaatattttttatgtacagcatttttcttattactggcatattttaaactttattttttgtgagaattttttttacagtactatggaaaatccttccaaacaagaaatgcataatatgcaatttaaaatataatccttagta

SEQ ID NO: 259844 - DNA, 527 bp, Homo sapiens
gcccaattgtttcaagctatgaaattgtcagatacttacaagcaccatgtgctgaaaactaccatcttctgcagtgctcacaagggtctgttttaattggtggctttactcagccatgtttctgtttttcaaaccccggagtcagttggactgcctccatatcaccacttaccacttccaagaggagatgagttcccagcccatcgctgcatacccaccagcttggacgtagctccagttgctgccaaacaacagcctcgataacttttgaggtttcttctgttcctgggaggctatgattcagtcttgtcttctagcaatattatggaaactgcatgccagtaaccttttagatatcatcttgatcttcatgatactgactcataaacttaataactcttctaatttgcaaaagcaaaaatgtacactggaaagatcattatgcccccgctaggtttgaagcctggcttccaaggcttagcttcctcatcagaaaacagagacctcacctatctcttcccctaaaa

SEQ ID NO: 259845 - DNA, 172 bp, Homo sapiens
gggaagaaaagctacgaggtttgctcttcacagaattaatctgtgaaataatggattgtagttactggattaaaatggcagaaaacctagtcttggcctccttaagaccatcagactccctggaggctctgagttggcttctctctttacacctagattgcaacaagaccta

SEQ ID NO: 259846 - DNA, 437 bp, Homo sapiens
cagcagaggctgtctaggagattgggagtctttgatccccataccagagaccaggtatgtagtgcatcttgttgctggtggctagtgatgccatcttaaatactatcgtgtgtgtttgctgtttcattataggatgtgttaacttcttgttagaaactggggggccgggcgcggtggctcgtgcctgtaatcccagcactttgggaggccggggtgggcggatcacgaggtatgtagatcgagaccatcctggctaacatggtgaaaccctgtctctactaaaaatacaaaaaattagccgggcacgggcccctgtagtcctagccactcaggaggctgaggtaggagaatggcgtgaacccaggaggcggagcttgcagtaagccgagatcacgccactgcattccagcctgggcgacagagcaagactccgtctc

SEQ ID NO: 259847 - DNA, 1533 bp, Homo sapiens
gatggtggcaggtaccctgacatgcccactgctgctgatgttgtgaatgctttagatcaacaggcacttgcatctatcctaagaacatacggggaggagaagcatgccaagaaaatcgcttcagcaattgttcaggcacgcagcatctaccccatcaccagaacccagcagcttgccagcatcgttgcaggagcatttcctccctctgctatttatacacggaaagacttactacagcgatctacccatattgccaccaagactttccaggctcttcgcatatttgtgaacaatgagctcaatgaactctacacgggactgaagacagctcagaagtttctgagacctggtggtcgtcttgttgccctctccttccattcactagaggatcgcatcgtcaaaagatttttgcttggaataagcatgacagaaagatttaacctaagtgttagacaacaagtgatgaaaacatctcaattgggttcagatcacgaaaacacggaagaagtctctatgagaagagctcctttaatgtgggaattgatacacaagaaggtacttagtccacaagatcaggatgtacaagataaccccagagggcgctcagccaagcttagagcagctatcaaattataagttatcatcatcttattcttcaaatttttttctcacaatttctctaatctttactcatgttatgtccctgaatgtcttggtataggtttaagtgtgggacagtctgaaaattgatagcatttagcatttcttttttctcaaaaagaaactgtaggaaatacatgacagagaaagttacactcagggagcagcagcacctccagactggaaaaatgtgttaatctttgcatcatattggactcttgaaggcaatccttcctctggccaggaaattttttaaaaaataatactgtgttgtgtttatctaaatacgtaaactcaagctaccaaagagaaagatgttgtaatcatatctgcatgtcctaaattttgaatttagatattccaatttgcatcagtctttctgtggctcaaataatgatgattatggaatgaattttaatgtccctacttgtgaataattagctttctcaaatgtaggctttttacaaattttaaattttaaaatattagtttaaatgtgtgttatactgataaaatttcatctttcaaattatagtctattattttaaagggatttttcagtatgatatgggccattttgttcatctatcgcaaagtaaaaatgtaaaatccttacagagaattgtttcacaaaacttatatttcatgtcaattgtatttattttaataatagctcacaatgcctttagtaagtaataaagtctcttattagaatcttgtattttttaattgagctaatcaaaataattcagccaagtctatttgaaatagaaaactgtctatttaatatagtaaaatcaatgctcccttaatgttgttacaaagatatggtaactgtaatatgggtaaaagtttattcaagaaaagagtact

SEQ ID NO: 259848 - DNA, 427 bp, Homo sapiens
tccctccagcaattatattttattttttgagatggagtctcactgtgttgcccaggcaggagtgcaatggtgagatttcggctcactgcaacctctgcctctgggttcaagcgattctcctgcctcagctcccaagcagctgggactacaggcatgcgccaccacgcccggctaattttttttgtatttttattagagatggggctttcaccatgttggccaggctggtctcaaactcctcacctcaggttgtccacccacctcagcctcccaaagtgctgggattagaggcgtgagccaccgagcccgggcacactatttttaactggaagctgctttcctatgtcagtcctctaaacattaatttttataaaagtgtgtaaaaccttcctaggaaagataaaaataaattttaaaaattgtttct

SEQ ID NO: 259849 - DNA, 525 bp, Homo sapiens
catcaccatcaatttttaaaatacattatattttacacacttccttttttaaaaaattttacttttttatcacccccaccccacagaatattatcttaaggtaatgcatttttatgcttgaaagctttttattaatctctgtgatacatggctttaataacaatagttatataaattgaagctaagtttaaaaatttcctataactaattctgtaagttgtaatttttcttttgggttgagttattataaatagttgattagaatagcttaaaaacttgatggattttaatgaataataattattaagagtagaagtttactggaaatctgtgtcctaatggaatggatagtgggagttgtgcctaaattaaaggagggtctttgagcccttcgacttattgtttgttggtagggaggcttttccatcctggggcagtgtaccatagtaagaataggagtgggtgagaagtatgcctttattttgtaaagtggaagattgtgaaaggatcttggggaataaaaat

SEQ ID NO: 259850 - DNA, 850 bp, Homo sapiens
  misc_feature (39)..(39): n is a, c, g, or t
cgcccgcccgcgaaacctacggctaggtacgaggctggntgtcgcggcgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtgagctgggggatatgagggggttgggctgttccagtcctctgtctaccctctctgcctcctgcctgcaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggtcagctccactccaggactgaataaaggtctttgacagctc

SEQ ID NO: 259851 - DNA, 779 bp, Homo sapiens
  misc_feature (39)..(39): n is a, c, g, or t
cgcccgcccgcgaaacctacggctaggtacgaggctggntgtcgcggcgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggtcagctccactccaggactgaataaaggtctttgacagctc

SEQ ID NO: 259852 - DNA, 1441 bp, Homo sapiens
  misc_feature (39)..(39): n is a, c, g, or t
cgcccgcccgcgaaacctacggctaggtacgaggctggntgtcgcggcgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcaggtacagcggccgggaactcctcgccctttgccggaggctacaggagcccggggctggcagggacctctggcagggcacttagccccttcgagcctcggtttccgcctccgtaaaatgggtctggggagagtccctccgcccaagggctgcagcgagaggtcagcgatccgtgtccgtcggccccggtgcacctgccggggcgccacgtcctcgccgcgtgggcccctcgtacgcgtccttgcgcgcacgcctgggccgggacacccctttgagctgtttcccgcttagaggcggagccgcccctgccggcgactacggagaggttcgggcccccccggcgggaattaagaacatcctgaggacaatgtcagtgttgctggggccaccataggccgaatttgggtatctgagccccaggatcttcttgcccctgctgcagaccctcttatcctgcgctgtcccgggcctctcttccttatccccattgctcagggaggtaaactggcctccagaggtcgcatggcttgcctggggcctcccagtaaactaggggcagaggcaggcgacacttcggtgggccagtggccccccccgcactgccgataccccgacctctccgtggccccaagagtccaaggaccagactccttgtgtctgtttagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggtcagctccactccaggactgaataaaggtctttgacagctc

SEQ ID NO: 259853 - DNA, 1512 bp, Homo sapiens
  misc_feature (39)..(39): n is a, c, g, or t
cgcccgcccgcgaaacctacggctaggtacgaggctggntgtcgcggcgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcaggtacagcggccgggaactcctcgccctttgccggaggctacaggagcccggggctggcagggacctctggcagggcacttagccccttcgagcctcggtttccgcctccgtaaaatgggtctggggagagtccctccgcccaagggctgcagcgagaggtcagcgatccgtgtccgtcggccccggtgcacctgccggggcgccacgtcctcgccgcgtgggcccctcgtacgcgtccttgcgcgcacgcctgggccgggacacccctttgagctgtttcccgcttagaggcggagccgcccctgccggcgactacggagaggttcgggcccccccggcgggaattaagaacatcctgaggacaatgtcagtgttgctggggccaccataggccgaatttgggtatctgagccccaggatcttcttgcccctgctgcagaccctcttatcctgcgctgtcccgggcctctcttccttatccccattgctcagggaggtaaactggcctccagaggtcgcatggcttgcctggggcctcccagtaaactaggggcagaggcaggcgacacttcggtgggccagtggccccccccgcactgccgataccccgacctctccgtggccccaagagtccaaggaccagactccttgtgtctgtttagtttcccaggcggcaagtgcgacccggctgaccaagatgtggtgcacacggccctgcgggaaacccgggaggagctgggcctggcagtgcccgaggagcacgtgtggggcctgctgcggcctgtgtatgatccgcaaaaggccaccgtggtgccagtgcttgctggtgtaggcccactggatccccagagcctcaggcccaactcggaggaggtgagctgggggatatgagggggttgggctgttccagtcctctgtctaccctctctgcctcctgcctgcaggtagatgaggtgtttgcactgccgctggcccacctgctgcagacgcagaatcagggctatacccacttctgccggggtggccacttccgctacacactacccgtcttcctgcatggaccacaccgggtctggggcctcacagctgtcatcactgagtttgccctgcagctgctggcacctggtacctaccagccccgcctggccggcctgacctgctcaggggctgagggtctggcccgccctaagcagcccctggcttcaccctgtcaggtcagctccactccaggactgaataaaggtctttgacagctc

SEQ ID NO: 259854 - DNA, 639 bp, Homo sapiens
ccgctgccgctctgcagccccccaggcgggacgcgtcgcgcgggctgccccttctccctctcagctttcggagggacccgggctgagcgccccgccccgcctcgccccgcctcttccctcgcccgatcccgcgccctcagtgtcgcggcgcgcaggacttgacatgctgcccgactgcctgtcggccgagggcgagctgcgctgccgccggctgctggcaggggccacggcccggctccgcgcgcggcccgcgtcggccgcggtgctcgtgccgctctgctcagtgcgtggggtcccggcgctgctgtacacgctgcggtccagccgcctgaccgggaggcacaagggcgacgtcaggtacagcggccgggaactcctcgccctttgccggaggctacaggagcccggggctggcagggacctctggcagggcacttagccccttcgagcctcggtttccgcctccgtaaaatgggtctggggagagtccctccgcccaagggctgcagcgagaggtcagcgatccgtgtccgtcggccccggtgcacctgccggggcgccacgtcctcgccgcgtgggcccctcgtacgcgtccttgcgcgcacgcctgggccgggacacccctttgagctgtttccc

SEQ ID NO: 259855 - DNA, 275 bp, Homo sapiens
tttttttttgcttttaagcacatacagtgactcaaactagggtgctttagtaaatgaataagagtgataattagcatcttgtctctttggagggaaatgctagtgctcaagagaaaattttttctttaacaaaagggtaaaagcaaacttcagcccagccctgtcaaattactcccaaatgttgagtctgcggaggcgctgcttaatcaaatatagatgtaggtggctgagggtggtgggggatgattttctccaagcagcctttaaaaaacagg

SEQ ID NO: 259856 - DNA, 674 bp, Homo sapiens
ctccgggctgcaggaattcggtacgagcgccacttcacgccagcctgggtgacagtgtgagactccatctcatatagaggtgattttttttgtaaaaataagtattgtgttgctaagcagttcacattcaaccaagcacttgcaaggtcagtctcacgatcagccaccagcagctgcgcattcatggctgctggtgaagagccgtatcacctccctgtgcctcagagacctcttctgtaaaataaggaggctggcctcgatcaaaagaccacttgtcctctagttgacacctgagcagctttaagaggttgaatgttgtatagagaacgatcttgtagaaatctgtaagccccttatgtgacacccagatgctgacgacccacctttagaaacttcaggccattttgggagagttggcagaatgagtttccacatattcactgctgggactgctgcttccactgtttggtggtcccccatccccttcagccaggagcacccactgtatccctcaaaatcccccttggggggccccttctcttattctctggccctccaggcaggaagaggacaccccagctgcccagcactgggccaggcctgtgagtgactgctgcctcaaggtgtagggctgtcctgtggccctccccacacccttgttgccaccacctgcc

SEQ ID NO: 259857 - DNA, 1548 bp, Homo sapiens
atcactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccattattcctgaggctgaaatccctcctgctcctgaagaaagcttcactactattccagacataactgcccttgaagaagagaaaataaccgaaattgacctaagtgttttagaagatgacaccagtgctgtggctacattaactggactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactga

SEQ ID NO: 259858 - DNA, 448 bp, Homo sapiens
gtggtaggacccgtcccttcttcagctctggtacccacctccatcccgtctgtaggtggcgtcccattctagaatggattaaaagtttggaacgctctagatgcttaggaaggagcatccaagggggaatggccgagcagcttgcaagctcacagcgatccgtgccttgccccctcctgccctctataccagtggccagcgagttaacagggaagttggcttttttttttttttttttgaagtgcagtctagctgtgttgcccaggctggtctggaactcctgggttcaagccaccctcccacctcggcctccagagtcctggggttacaggcatgagccactgcacccagcagaaacgctcctacacacgggtagccacccacccaggccccagactcctggactgctgctgtgggaatggctttcagggaatgactccagtgtgga

SEQ ID NO: 259859 - DNA, 484 bp, Homo sapiens
gaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcactta

SEQ ID NO: 259860 - DNA, 332 bp, Homo sapiens
gagaatatctgaagtaaaggatctttcataaaggatttcttataatgttaaaatccctcctccatttccaaatatcatatttaagtgttcatatattgacgtctgtcaaaatggagtacacctgaacctacataaccatatatacgtgcaacataacacatacatatgtgtcatagctcatttccattgttgggatttgggttcccctcatcatgtttgcttatttatatcaaatctatctagatcataagcactacgaaagcatcaatctcttttattttgcactccctaaagcgcacatccatgtgactgcaggatacacctgcagggag

SEQ ID NO: 259861 - DNA, 425 bp, Homo sapiens
gaagaaaagtgaatcttacatagcagctcagcatatctctttaacaacttctacaattgcctattctgacgaccactgactattgagtctctgtaacttgttcaagttctttcaatgctctacaaaggagaactagttaaggatataaacataaagaaaattcagaatcttaataactactttcgatgtgtcataaaattaaactacaccacaagattccaaaagataacaccaaaatattcatttgaagtaaaaacaaaaaaaaatactgagactcctctcctgtcacagaagaaaccccttctgtgtggcagctcaactcagtttttctgtttacttcagactcttttcatttcctactacagacaggtagctagactctattagtattcatgtgtgctcacaaatcaggttttagctaaaag

SEQ ID NO: 259862 - DNA, 360 bp, Homo sapiens
tatgtggggatttccccctaccagcaagcaagcaatcagttctgcagcagacactaactgcgtatcctccaatttaattctgacactatctgcctggaaatagcatcagatccctcaggttgagggctcagtccccaagactgccatcccttcagacaccagttgcaagtctgggcctctagaacttctgaccagctgggcttcaagttggcattcccagacatttacagtggctcatggctggaggatcacttgaggccaagagttcaagaccagcctgggcaacagagtgagacctgtctcaagaaaataaaaagtaaaattagctgtgcctggaggtacaagcctgtgtagtcctag

SEQ ID NO: 259863 - DNA, 1412 bp, Homo sapiens
aacaaacctctgggctctaagagccccgcaggctgtacctgcggatttcccctctcagccaactccagcctctgctccccctctgctcctcacttctctaaagcgaaacatctcacagtcatttgctccatgcttcctgtacgatttctttatttttactctccagtttgtgggctgagtctgtgtgggtgtgggagaggggctgggtatttctacttctctggcattttccttctgagctgggaggactttcacttcctccccagtctctcagttctgcctttcatgggctgttcaggccatgagaccacctctcctaatccttcctgagcaccagggaaatggaaaactgactgtaactggctgccctggaagggcctagcatccactcaggagcaacaggtggtggcaactacagcagtaacagtaacctccctggggcaggagccttgggctggcgtgacagcagcagaggcagccaagggagccctgcttgctcctgaggccatccgagccctggaacctgtcttgcatccctctaacaccaccatgggcaagcctgggcctccacttccctccctcagccttttctgtcccagcactcagccagacaagagtgactctcagcttgccccaatgcccccagctctgcctgctgatctagttctatatttgagagtcttagacatctaccacactggagcacagagccacgggaggggttggcctccatcaccggggcctgacaacctgccatcccgccatcccaacctccctgaacctcagtctcctctttcaaacaaagttatatgtagatacagtggaggattagaaaacattgaatgggtgccccaatcaacagtgtctgttactggcaggagttataaatgtgtattgaaaatggaatcccttctttttttcttccaatcataaggaccacaaccatccaaaaagcaaagagagcctcagacactccagctcagcctctagttgcagaaagtcacctcctcaaagggagagatcagtgttcacctaggactggaattcagtgtgatctagtggttgaaagtcttagccttcagcctccccagcctgtcagctgttccagaagcctgtcagctgccccttagttttctgctgtgtcctcaaagaagcactgggaccctaaaataaacctctggagagccagttgcccaactcttccagaagagagactagacacgcagctgggcatgcggccagagcccaagaaaagcctggtttgccaggggcagattacagtcaacgggagcagtaagtgcctctgccctctccctcacgggtccttctcttttctagaggggagtccagcacgtgccagccccaggaggtctcactcccttgccagcctcccgactcaattcccaggactg

SEQ ID NO: 259864 - DNA, 1966 bp, Homo sapiens
aacaaacctctgggctctaagagccccgcaggctgtacctgcggatttcccctctcagccaactccagcctctgctccccctctgctcctcacttctctaaagcgaaacatctcacagtcatttgctccatgcttcctgtacgatttctttatttttactctccagtttgtgggctgagtctgtgtgggtgtgggagaggggctgggtatttctacttctctggcattttccttctgagctgggaggactttcacttcctccccagtctctcagttctgcctttcatgggctgttcaggccatgagaccacctctcctaatccttcctgagcaccagggaaatggaaaactgactgtaactggctgccctggaagggcctagcatccactcaggagcaacaggtggtggcaactacagcagtaacagtaacctccctggggcaggagccttgggctggcgtgacagcagcagaggcagccaagggagccctgcttgctcctgaggccatccgagccctggaacctgtcttgcatccctctaacaccaccatgggcaagcctgggcctccacttccctccctcagccttttctgtcccagcactcagccagacaagagtgactctcagcttgccccaatgcccccagctctgcctgctgatctagttctatatttgagagtcttagacatctaccacactggagcacagagccacgggaggggttggcctccatcaccggggcctgacaacctgccatcccgccatcccaacctccctgaacctcagtctcctctttcaaacaaagttatatgtagatacagtggaggattagaaaacattgaatgggtgccccaatcaacagtgtctgttactggcaggagttataaatgtgtattgaaaatggaatcccttctttttttcttccaatcataaggaccacaaccatccaaaaagcaaagagagcctcagacactccagctcagcctctagttgcagaaagtcacctcctcaaagggagagatcagtgttcacctaggactggaattcagtgtgatctagtggttgaaagtcttagccttcagcctccccagcctgtcagctgttccagaagcctgtcagctgccccttagttttctgctgtgtcctcaaagaagcactgggaccctaaaataaacctctggagagccagttgcccaactcttccagaagagagactagacacgcagctgggcatgcggccagagcccaagaaaagcctggtttgccaggggcagattacagtcaacgggagcagccaatcctaacccagatcaaagatcctgggacagctggaacaggcatggcctaatggaactcccaagtggacagggccaggcatggacggacagagcttctgaaacagtcctcagaccccgtgcatctggatctttctgtaggaaccacccatcagcagtgccagacagaaccaagcacatgcactgatccaccgcacgatgggagctggtgtgggtgagcttgtttgctttagccatgcccacagacaggaacagaagagcacagtggaggccaccagccctctcgcctgctatttcaaaaggggttgcagcagggctggaaagcggttcccactgtggttgcccccttcctctctgtggcacacacagacctgaaaataaccagagagggactgtgagctgccagcctaaaacaggaaggctgcagaaagtcctaggctcagataggagagtttaaaagaatgttgaaaccaagaacgggcatcacagatcccacctgtctctgcaccaaagcagacctccccctctctaatctactggtggggagcctgtgtgctctgtagtcatgcagatcccagctttaccacttgctggctgtgtgacttaagcaagctatttaacttctctgaacccctatttcctgatttgtaagataagcgcagcaatataca

SEQ ID NO: 259865 - DNA, 373 bp, Homo sapiens
gggctcctaaagtgctgggattacagacatgagccactgcgcctggccacagatttattatctcttatggaaaaataactgggctcttggctttgggcctcagtgcaagtccattggaaaaggcagctgcaacaatctagtggtcaccagcagtcccatgatggttcagcgactgggactcatttcacctccagcaagccaggtctctactaaaaatatttttaaaaattagctgggcgtggtggcaggcacctgtagtctcagctacttgggaggctgagacaggagaatggcttgaacctaggaggtgaaagttgcagtgagctgagatcgcgccactgcactccagcctgggcgacagaccaagactcca

SEQ ID NO: 259866 - DNA, 925 bp, Homo sapiens
cgggcaccggcggcgagtgccgcggccactgcccctcccgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcc

SEQ ID NO: 259867 - DNA, 717 bp, Homo sapiens
cgggcaccggcggcgagtgccgcggccactgcccctcccgggaccccctgtacgccgtccgcgccgtccagggtcacaccggcgacggaacccgccggcagcaattagccagcatcccggggtcggcccccagaagcattccccggcccaggacgaggatgaacaggacaggcgaggcacaaagtcgcaactgaactttttagaaacattatttgtgtgtgtatgtgtgtagcaggggagaatgagctgatgccgagggtccagccaccccgcctctgcctcctcctccccctgccgccgctgccctcgcagacgcgcgcgcacacacggcacttgggccgggtttccgcgctccgtccccccgtttggatgggggttttcatttccgaaggaggcacagcccgcggagcgctctgaagggctggagccccaagttactcctcgccagcgccggccgcccgctgtcactcgcgctggccggccgggggaagggacccgcacgccgggctttgttgtggaaatcccggttacctggcttataacccacaccatggataacttattggactttgcctgaaaggagtcattagtgacattggatatttgaccgtcttggccacaggtttttcagaatgaatggaagatcatgcagcatgagtctccaccggacatcgggaaccccacaggggcctaggatggtcagtggtcatcacattc

SEQ ID NO: 259868 - DNA, 720 bp, Homo sapiens
acacatcctttatggttgaagggtgttggaggaagcagagttttcatcagctgctgaagtggcaactaatagaggtttgaatggccgtagaaaaatattgtgttacttgtttgttgtctaggggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcc

SEQ ID NO: 259869 - DNA, 397 bp, Homo sapiens
accacaagatcaaactggcctgaatccctgagtcatcacatggaggacagctgcctacaagagtctcctgacctatagtgggctctggatgagtgagaagtataacaaaatgtgtgcattaattacagacctttttggcttctttgttagtacagctagacctataacatcctgattaatatatctttgtataaagatcaatgtgttgactattatattgaactagacacttttaattattgatttaaaatatattgttgatttaaaatgacctatattctctaagagtgagcagaaaaattggagattttacccagtttcaagggactgaacaagctctgaatatatttaaagggcaatggcaaacaaaataaaaaaatttttgaatatgtctcat

SEQ ID NO: 259870 - DNA, 420 bp, Homo sapiens
aaaacggcacgaggaaaaaaaaaaaaaaaaagaattgagcactgttgggagggaaagtcctttccctggtctcatgtttttgtgttgaaggacctccattgaaatacaactcttggcctgtagtctcactcctcacacactccttccagcagagaaattaattacctaattgctaggtggtgatggggtgctaacggggtagaacaactctatcaaaggactgtaaacttcccattttcctccctagagacagctccaaactttcctttgggtgcagagggaggctttggatgtgtatttggatacaggagagagttggcagtcacagagtattaataggctctttggttcacagatctaatgtcattttctccaattggtttatcaataataaagctgacagtttaaactctaaaatgt

SEQ ID NO: 259871 - DNA, 477 bp, Homo sapiens
caggcagcaggagcgcgcaagtgggaagcggggatcccagcccacgtgcgtggggtgctcccagctgccccgggacctgtccccagggcgaccctgggaggagaaggccccatcccagcgcctgcctggaaggaggaacccggcccaagaggagctgcccggggcgcgcccaggctcccctccccaggcctcccggctcgcctcccctcccctcccctcctcctgcggtgtttgcctccagccttccctagattcccacgccggcctcaccctacagcgctgcgcgactgctttgcagaagccagatgattctgcccgtgcaggaatgaagtgcgacccggcgcgcgagggagggaggcctctgcgctttggctccggccgcgcctcctccctgggatccggtctagggctggccgagctccgcggatccctgctcagagcggggctgctgcaccacctgccgcgggtggccaaagc

SEQ ID NO: 259872 - DNA, 378 bp, Homo sapiens
agtgaaggttcattctgaatgtgcatgtgtgtccacaggagattttacagctgaggaacctgaggctgagaataatttcatgactttaccatgttctgatttggcagagtctgaaccgggagtcagtttgttcttccatatgactccctttactgaaaaattcactgaagagcttttccgaggaaagcagcctctcctggcctttgcctatttcagcctgacttctctccatccggggcgcctctccactccactccaccccacccttccccacccattccctggtagaagctgccagtcttcatgggcggaaagcatgaatgaactagaatttagcttcaaccactgccttttgaaatgaaaaatatctgccttatt

SEQ ID NO: 259873 - DNA, 359 bp, Homo sapiens
tttgtaatgcaattagatgttttggtgcaggatgcctttattcctggctcctcctgaactcatgacttcggtgcaatgggtaattccttgaaatacacaaactaccaagagttacacagaagaaataaaccattcaaatggaccaatatcagttaaagaaattgaatccataaagctttcataaaagaaaagaaaagaagaaagaaagaaaataaattatcagacttttttggtttcattggtgatttctgtgcaacatttaaggaagaaatatataagttctctacagtgtctttcagaaaagagatgcaaagggaaccttcttaacacttttgtaaaaggctgttttttctctaatc

SEQ ID NO: 259874 - DNA, 575 bp, Homo sapiens
tcagttctgtacatctgcctatattccttgtgatagtgctttgcttttttgtagataagcttccttcttgccttttgaagcatcctttgggcagacttctttctcaggcacttgatcttcagctctgtgaaattccttcactttttcctaagggtttctggcacagcaggaaccgtcttcttcttctcttctacaccatccatggttccagccagaaaagagctgcttgttgatttaagtcccttatagattctggctattagaccttggcatatgcaaagtttgtgaatattttctcctatcgtgtaggttgtctctttagtaatagtttcttttgctgtgcagaagctcttctgtttaattaggtcccactcatcaatttttgtttatgttgcaattgcttttggggacttagccaaaaattctttgcctagaccaatattgaaaagtgcatttcctaggttttcttctaggatttttatagtttgagattttccatttacatttttaatccatcttaggttaatttttgtatatggtgaaaggtaagggtctagttttattcttctgcatat

SEQ ID NO: 259875 - DNA, 480 bp, Homo sapiens
gccctaacctcatgtttcataagccatctgagaatgttgttggtctcagctggagggcccctagcccaggttggcctctctggagcctgaagggcactgctggggagagacccatggccactgacccctccttctggagcagggtctcccagaccccagcagggtatcctccgaggtgcagcagatgtgggcactgacagagatgatccgggccagtcacacctccgcaaggatcggccgctttgatgtggatggctgttatgacctgaacttgctctcctacacttcatctgcaaggtcacttacatagccccactcagctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcaaaaaaaaaaa

SEQ ID NO: 259876 - DNA, 232 bp, Homo sapiens
tagactctgagaatatattatgacttctagatttcctcttttttcttaagtaaataaatcatgttcaaaggatgtaagagaaaggagaggcaagtatttttgtttgtttttctctgaatatctgaatttcatagaataacactatacttctcccaaaagaaacactttcaagataagttatgttgtcttttcttttgtaaaattcccatgaaaaagcttacaaaccatactt

SEQ ID NO: 259877 - DNA, 453 bp, Homo sapiens
agctgggattcaaatctggatagttggggtctggagtctatgcttttagcctcttattgggagggtgaatgatgaacacagtggggaggccagatgattttgataacttccagattgcaaatctaaccatgctgatttaggaaattaacaatttagtgatgatgcaaaccagggatctgcaaactacagccagtgagtcaaatcccacctgaaacctgtttttatatagctggcaaactagaaagaattttcacataaatggttgaaaaattttgtaaaaatctgttttctcttttgttacataagtacctgcacatatcctcaatttagtctcttgtcttgcaaagcctaaaatatttactagctggtccttcacagggagtgttggtggcttctaatctaaggtaaaatcaactacaggaaaataaaataaaataaaataaaagtttttta

SEQ ID NO: 259878 - DNA, 1230 bp, Homo sapiens
cgagaagagtggtagagaccaggtcagaggtagctgtttttttgtgtgtgtgtgtgtggtggagatgggttctcactgtgttgctcaggctggtcttgaactcttgggcttaagcgatcttcccatcttggcctcccagagtgctgcgattacaggcgtgggccaccacacctgtcctgtgctaggctcttaacgtccttcccagatgttatgtcccttcccttggtggctgctgctttctgccacattttaccttgccgttccgcaccttctaccatgtctccttttccagcctcattccctgagatgtagccggagttccagttcagccaacctgcccgttgttttctctcctggaactgggtgtttgagcctcctgcatggagtgttcttccttcccagctaaagtcctggtcatcccatttccatctgaaaggcccccttgttcatgaagcctctcatggtccttccccctaccccagccaggtatactttctctcctcttggaattatcctataggaagaacatggtggcttgacctgggttccagtctcacccatctgtttacctggggagtgatcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgtcttaccttgttttaataaattataatcttatgggagatgacactgtcttttctttgtttcatatataaaaagtgttttgctgatatacgtagaatcaagttggtctggagttactctggataagggatgaaatcagggagctcttgtgttcaaaggggccttcttcccttttttggttctttctcctcattttttagcttccatttttacttcctttagtattgagaaagtaccaggctcacttcaaagagttgacttcaaagctcccaccagctcagacatacttgccactgaagcctgtaggaattggcatcaatggaagaccctgtggcggttgcatttaagattttttttgggacttctatttttataattcttttaaatggtaaagggggagggttacaaaatatctgcgcctttaagatatcaaacataagccagtgaagttcc

SEQ ID NO: 259879 - DNA, 262 bp, Homo sapiens
tccccgatcaaacccttttatgttgctgtgcggagatgggttctcactgtgttgctcaggctggtcttgaactcttgggcttaagcgatcttcccatcttggcctcccagagtgctgcgattacaggcgtgggccaccacacctgtcctgtgctaggctcttaacgtccttcccagatgttatgtcccttcccttggtggctgctgctttctgccacattttaccttgccgttccgcacagcaacataaaagggtttgatcg

SEQ ID NO: 259880 - DNA, 422 bp, Homo sapiens
ataccacttcatacccagtagaatggctgtaatcaaacatgaattataactgctggtgatgtggagaaactggaaccctcaaagattgttggtggaaatgtaaaatggtacagctactgtggaaaattttggcagttcatcaaaatgttaaagttgggccaggaacagtggcccacgcctgtaatcccagcactttgggaggccgaggtgggaggatcacctgagcccaagagtttgaggccagcctgggcaacatggggagaccctgtctccacaaaaatacaaaaaaaattagctgggcatggtgtcacgtgactgtggtcccagctactcaggaggctgagttaggaggagcctgggtgaggctgcagtgagctgtaatcatgccactgcactctgggcaacagcagagaccctgtctc

SEQ ID NO: 259881 - DNA, 399 bp, Homo sapiens
gcatcccttgaagtctatgttccatattcctgagagttcaggactgtgcagtgagggattcagatagaaagagaaaaggagcattggagagtacatagtgacctggacaaggcaggtactcaaaaagtattcataagatgtacgcatgggctgggcgtggtggctcatgcctgtaatcccagcacttcgggaggccaaggcaggcggatcacgaggtcaggagatcgagaccatcgtggctaacacagtgaaaccccgtctctactaaaaatacaaaaaattagcgtggtggaggctgcctgtagtcccagctactcgggagactgaggcaggagaatggcatgaacccgggaggcagagcttgcagtgagctgagattgtgccactgcactccagcct

SEQ ID NO: 259882 - DNA, 431 bp, Homo sapiens
catggtgagacctcccatctctattaaaattattttaaaaataaaattttaaaaagcattaaagtgacatagtcttcattaggcaaacaaaagatagctttgcccagggaagagtatgaacaaaggaatgggaaatcaaaacagagagcccatctcctcctggaactacaagtagttaatttagctaacacctagaaaatggagggcagggatttctactaaaagaactgaagcctgggcaacatggcgaaaccccatctctactaaaaatacaaaaagttagccaggtggggtggtgcatgccagtagtcccagataactcgagaggctgaggtgggagaatgacctgagcccaggaaatcgaggctgcagtgagctgtgatcttgccactgcactccaacctggccaatggaagtgagaccctgtctca

SEQ ID NO: 259883 - DNA, 598 bp, Homo sapiens
aattcattctttcctaatgttgaaatgctggcagtccagtgagtcaggtaaccatgttacaagaattgtctcacaaattctgtaaggaggtagggaacaaagatacattctgatgtatgtttcttctattaaatctattttggtattccaagtgacatttgttcttgcacagcttatgcttcacaccaacatgctatctgtcagggcacacactgattaagacctattctgagaaaacatattctctgtgattgaaatccaaacgtattgattgttttatttccatcaggagagattgctttctatttggtgatggatgacaactcttcacacctctctgtctgccagctggacagaggatgacacaagcagcctctaagtcttgtgtgggctgagccattagctatgacaggcagctccaagccctcagtcacttcgccatggccctagcatcgtcaagtgagcaagattagacatgtcacagttgcaagatgatgcctaaaactgatggcttggtgaaaagaacctttaaaaatgacaaggccatcttaaaagctcctgaacagggtgggacatggaggggtttgagagcagagcc

SEQ ID NO: 259884 - DNA, 239 bp, Homo sapiens
ttggtagaggattatccaagacttctcctgcttccaggcatgcgtacttgcccagttggcttttactggcattcttggtgctggagaagcgttggagcaaatataaatgcatgacacattcttaaagcaggatgctgtccaagaaaggctaaaaagaaaaaagctgaaataaattaaagataaaacataggtaatacaaaaagagtacaacagcctacaataaaattccactgagaact

SEQ ID NO: 259885 - DNA, 507 bp, Homo sapiens
gtaagcctagttatggacatactccccgtctccatttaggattatataaggattaaataaattttctggggcttggagagaagaaatgggggtgtattttccgccttcctcctgttttctgcatgtatttttaggtaaagatgtgccagtttttattgcaggaatattagcctgaaaaggtttatccagaatcagtcggttacttcctattgactttaaggatcagatgaattgtgatcaactttcataaaatgtgactggaatttagtgctgtatgatgaatcaagagtgctctgagggttgactttatgagcagctaattaaatatacaatagaggtcttgttccagtaagctttttaataagcttagaaaaacttcctgaaattcagattctttccttccatcagtttaatgggaggaaaaacccttctatagtgaatagtttcatgggcatataagctattgtaatatacatgcagttttctactctcctaattaaaaaaaat

SEQ ID NO: 259886 - DNA, 184 bp, Homo sapiens
  misc_feature (61)..(61): n is a, c, g, or t
atggcggtgcagaggctgtgaaaggcctgcatggccaggctgtcaccagcacatggctcanggtcatgaccctgagggattctaaaagagggagaggaggagtagtgatattatctcatctttttttcctttcctgttttgtatttctccctctccctctccttttccctcttcaccggccatc

SEQ ID NO: 259887 - DNA, 471 bp, Homo sapiens
cacagccctcatgcttgccatatgccatggatcatcagagatagttggcatggttcttcagcaaaatgttgacatctgtgctgaagatacgtgtggaatgattgcaacgttatgctgttgcttgtgggtttaatctcattgatcaacaacttttggaatataacaaaaggtatctaaaaattctcaaaatagcaatccaggtaagacctctgatagtaaactacacttggtggtgctaccatgagattataggagtgttgatcacaaaagaactattaaaaaagcaatgtgtaagtagcatgtgtttacatatatacctatatgtaagtgtttttatatatacatagctttgatttaattttttagtttataattcagaattaagaatttagttgggcaacccgctcgggtccccttccacactgtggaagctttgttctttcgctctttgcaataaatcttgctagtaaa

SEQ ID NO: 259888 - DNA, 370 bp, Homo sapiens
aagtgtagaaccctagggatacgccgacgggtgggtcatgaaagaagaaacttgagaaaggaggaaggagcagtcaaaacaaaatgtgaagagcatatattgagtattgacaaggagatctttgataattggggaaagcagtttctttgaagtggtggaagatggagcacagatacattcctagttcccaggcattccttttttattcatgacatttctgtatgttgacgcttctttcagtattataactccttttgagggacagtcctgtattgatttttgcatttagaagaatttcaaacctaagatccagtgtggtggctcacgcctgtaataccagcactttgggaggctgaggcgggtggatcac

SEQ ID NO: 259889 - DNA, 485 bp, Homo sapiens
agtggctttggaacttggggcctctttgggacctggtaggcaatggggtttgggggcaagtttgtgggacatgtgtctgaacaggaaggaagggaggagcagtggggccagccaggaagcagtgccgaatgcagatttctcttcttgtgcagctttgcttagagttgaacattacttcccagagatagattgaccccaatcctgcagagattggctatcctgctcttcaacttatttttagatatatggtctcacttgaatctcacatccaatgaggagttcctgacccctcaatttagctccacctggcattccagagcaattcaaggacctggtagggctactagcaatccactgctacatataggggaacaatgagttttaaagctgctcagaaatctgtgattcgagtatcaggaaatccttgactctttatcaaatgtgaagttgctgatttaagaaataaagttaagaaacaatattca

SEQ ID NO: 259890 - DNA, 445 bp, Homo sapiens
acacatattctcatttataagcgggagctaaaagatcacaacacatggacacagagaggggaacaacacacactgggacctatcagagggtggaagttgggagaaagaagaagatcaggaaagataactaatgggtactaggcttcatacttaggtgacgaaataatcggtacaacaaactcccatgatacaagtttacctatataacaaacctgcacatgtacccctgaacttaaaaattcagtggctaatattcgtcagaatgaatcatttctttccttaaatatgtagccttcctctgtctttacccatttttaaaaatccttttcttaaccccctctagttcttctttatgtgtagcataaaactgcagaattcagggtttgaatgtataagggttaaggaaactaatgtgcattgagattaaaatttaaagtatggactc

SEQ ID NO: 259891 - DNA, 207 bp, Homo sapiens
ttattctttttactaagttgtctcatgggacgtcctgctaaatatcagctgcccaaagtttataaactatttgttcagcccaggagaaaactgctatgaaaattacagaagagcagatataaaattcatttatcatgtctaattgtaccaacttagtcagcatttttcatttttattgttatcttttagcaatgttgttccctgtct

SEQ ID NO: 259892 - DNA, 105 bp, Homo sapiens
cagacagggtctcactgtattgtccaggctgaacatttctaggcatattgattttatgaatcagaaggggatgagatggcagcagcctcaatgaagagatgaatg

SEQ ID NO: 259893 - DNA, 385 bp, Homo sapiens
tcactggagctagcgtctttcttttaagagtgggttggatgacagaagctggagaggaagtggaggagatgagccctgggcacagaataatcattttaaaggggtggctgggcgcggtggctcacacctgtaatcccagcactttgggaggctgaggtgggcggatcaggaggccaggagtttgagaccagcctgaccaacatgatgaaaccccatctctactaaaaatacaaaattagccaggtgtggtggtgcatgcctgtaatcccagctactcaggaggctgaggcaggagaatcgcttgaacctgggaggcggaggttgcagtgagctgagatcgcgccattgcactccagcctgggtgacagagcgagactccgtctca

SEQ ID NO: 259894 - DNA, 472 bp, Homo sapiens
tatttttttgtagagacagggtctcaccatgttggccaggatggtctcaatctcttgacctcatgatctgcctgcctgggtctcccaaagttgggattacaggcatgagtcactgtgcctggccaatttgtttttttataagaagtagctggtctataggagaaatagcttttatctaacaaataaatctgttataatatcaaaacagtactactgactgcggcaattgcaatgatataccgcgcagaatttctgagtgtaaaagacccttagggctaatatcaaaggctccccttgtaccttatatgatgtttcttgttgttatttttctgaaaacacttcagagtgtccacaaatatctattagtccctcagtttatggtttactgagtgacaacattttgggactgatctaaagattctatataccccttattgacaagaaagtggggtggaaaaggggagattggaga

SEQ ID NO: 259895 - DNA, 454 bp, Homo sapiens
cttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttctcatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgcaatac

SEQ ID NO: 259896 - DNA, 504 bp, Homo sapiens
tcactttactaaaataaattgctcgtaatcttttggtgggttgtgcactggactttgagtcagaaaattgaaatggtaattgaatgttggccctgcccttgtgctagttacgtgtctacatccgagtttcctcaactaaaaatgaaaacgatctttttatctagggtaaccaatgcattcattaccccaggacttctctggcttcagccctgaaagtcccaccgaggagactgatccccctccatcccaggcaaaccagaatgattatttaccttacactttgccctggtccacagacttgtgggaggataagtatattagacagccctttttgaacaaggatagtcccttcatctagaagggattaaatacgtatttggcaggcttattgtcaaagtatgtttatgaaatgtgtgggcctccaggtttatcttccattataaccaactatgttttctacaacatcatggtatccaataaaaacctgtaaaaatcttggctcag

SEQ ID NO: 259897 - DNA, 243 bp, Homo sapiens
caaatttaattgttaaaattatttaaaatattacacttatcgataaaactatcaatagtatatactgcatttaatattagaaccaattattctctgaatgttcaaaaccattcatacaaaacagattatgagcatggtcatgagcaaacactggaggctacagggcagcaaagggaatcgctaagatcaataacgaacagttctcttcggaacaaagaagtagtccttggctaagtactaaaa

SEQ ID NO: 259898 - DNA, 395 bp, Homo sapiens
gaggtggaggttgcagtgagctgagattgtgccattgcactccagcctgggctataagagccagactccgtttaaaaaaaaaaacggttgctttaaaaaaaagtggttgctttctctggcagctagccctcctcctgaagcagtctaggagcttgcagccaccctgttagctcaacagcatcccacatgcattcttaccatgctgcagatctgaaagaccttagaggcccttgtgtcaggaacctgggactaagactaactatcaaaacagaaaatgctcctattacctctgtcacgaagggctttataagagctttggaagctttatgccaggaaccaggggcagagaccaaatgtatatttcttttcttatatttgagacagagtctcactct

SEQ ID NO: 259899 - DNA, 544 bp, Homo sapiens
gactctgttgcaactactccactgtgtcattgtagcacaaaagcagccaacgacatatgcaaatgagtgagcatggctgtgttctaataaaactgtatttatggacactgaaatttgaatgtcatgtaatttttatatgtcacaaaatattcttttgattttttccaactgtttaaaaccccttgtagcttgtggaccatacaaaaacactgtggccagatttggctactgggttgtaattgtgtgattcctcatctagctccttgctgctcagtatgttctgtggaccaacagcacgggcatcaccagaaagcttgttagaaatgcagatcttaggcctcatcccagacctgctgggtcagcacctgcattttaacaagacccctggtgattgtgtatacactgatgtttgggaagcactgggcaatgtttcattttttttatcctttctcatttagcactcttctaaagaccgaaccatttcgctagatctaacccattgcttgtaactgcagcacagtatttccatattcacttttccacc

SEQ ID NO: 259900 - DNA, 445 bp, Homo sapiens
gtagtgtttctctattataaaatgttttgctaatgagtattaggccaaggagaaatgttttccttaaaaagcacgtaagagacacctcaatttccatacctttctgttatcctaatagtctttcaacatgagggaaaataaatgcaatttaattttaaaagaaatcctaaaaattaaaggttaatttgcttgtaaaaaattagcagcaatcaatttaatttgagacttacattcttgcttaacaacaaataaaattctgaggtaaaattgccacacatttggatgaattccagaaaattcaatatacctaatttgcaatatataatccatcacacagagaaaaaaaatgcctcaaatatttatggcaaggtttttaaaaatgatcctgaagtacaaatactatgtttacttatttatatagggaatgtctctggaaggatactaa

SEQ ID NO: 259901 - DNA, 407 bp, Homo sapiens
tgtcttggaacgtagacccacttcagtatttctttcttactaagtgagatatacaatataattgagatgcactttatcttattagtactctaagagtcagtaccttgaaactaagaaactaaagaggcttgatgcagttattttggtctcaggcttcaaagggttaagctttcttttccttttaactttttattttgacataatttctgacttaagaaaattttgtgagaatagtacagagaattccatatacttttcacccaggttacccaccaaatgttaacactttaccacacttgcttttccctttcctttctgtaaatatattcttttttattttgagacaggctgtcactctgctgcactccagcctgggcgacagagggagaccatctcaaaaaaaaaaa

SEQ ID NO: 259902 - DNA, 457 bp, Homo sapiens
tgtcttggaacgtagacccacttcagtatttctttcttactaagtgagatatacaatataattgagatgcactttatcttattagtactctaagagtcagtaccttgaaactaagaaactaaagaggcttgatgcagttattttggtctcaggcttcaaagggttaagctttcttttccttttaactttttattttgacataatttctgacttaagaaaattttgtgagaatagtacagagaattccatatacttttcacccaggttacccaccaaatgttaacactttaccacacttgcttttccctttcctttctgtaaatatattcttttttattttgagacaggctgtcactctgctgcctcggatggagtacagtagcacattgtatgagtcaggatcgcgccactgcactccagcctgggcgacagagggagaccatctcaaaaaaaaaaa

SEQ ID NO: 259903 - DNA, 640 bp, Homo sapiens
  misc_feature (522)..(522): n is a, c, g, or t
  misc_feature (605)..(605): n is a, c, g, or t
  misc_feature (609)..(609): n is a, c, g, or t
gcagccccttgccagtcatgcgagtgggccaccttggagcagaccctctgattaaggcttcagttaattccagctttggctaacacctgactgtaatttcatgaacagctttttcaagccaaactacccagccaagtagcttccaaattcctgacccagagaaacaagttgtcaaagataagaaatatttactgttgttttaagcttctaagttttgggtaatttattatgcatggttaaattaatttttgtacattcccaaatcaggcaagtcagggtaaactttctcatccttcagtagccatgcatagtgcccatctaatgtgactcaaatagagaggaaatgggcagaaacttccacattcttttctttggatcccataggtattcttttaaaaaagacaaaggagaaagaatacaggaaacaaagaacatctgatgtgtattttacctagtttgctaatatcactggaacgctaagaaaggaaatgtcatagcatagcacattgaagctggcgtcgnttacaacgcgtgacttggccctgcgttaccaacttatcgccttgagacattcccctttcgcagcttgcgtataacgagaagcnccgnacgatcgcctttcccagtggcagcctgttgg

SEQ ID NO: 259904 - DNA, 228 bp, Homo sapiens
tgaggcaggaaaacacggcttccgctcggctgtctcccagcttggtttcttagaaatctatgtcattatctttctgctgggattgtcagacctgattttgagagcatttaaaacctgacccctgatggagcctctaaaatgcttcctgtcttctatttcaccaagcttttaaagcagtctccacctcccaccacatctgtagtggtggctgcttgggagctgttcctg

SEQ ID NO: 259905 - DNA, 583 bp, Homo sapiens
gagtttgtaaaagattgttatgaatttctctctaaacatttggtagaattcaccactgaaactatctgggcctatgtttgtttgtttgtttgtttgtttgtttgtttgtcagaagttttaagttactgacttaatttctttatttgtaatagatttattcagatttttaatttctacctgtcagttttgggagtttgtgcctttctagaagtttgtccattttacttccattttctcatttgttggcttacggttgctcagtttatttccttttagtgtgctatagaatccctttgctttctgtaagcttggtagtgcttcctctctttcgattctgattttcacaatttgagccttctctcattttttcttggtcaccctagctaatagtttgttgattttgttggtcttttcaaacaaccatcttttggtttcattggtttcctttattgttttctattctctatttcatgtatttctgcttaatctttgttattttcttcctgtgcgtgctttgggttttgttttttcttatttttctggtttcttaagatgaaagtttttgttgatttgaggtctgtct

SEQ ID NO: 259906 - DNA, 263 bp, Homo sapiens
aaacccgtttcacagatgcagacacagacacagatctgggctgacggcagggggtgccccaggccacacacagacacaccccaccccacggtgcccagcaatggggggcacccagcaaacatttcaatgcagaatctcagtgtgggctgggcacagtggctcccacctttgatcccagcactgtgggaggccgaggtgggcagactgctcgagcccaggagtttgagacccgcctgggcaatatgacaaaaccctgtttttac

SEQ ID NO: 259907 - DNA, 419 bp, Homo sapiens
tacatgtatttacatggctctttcttccctagttacttaaaattttcacattatacaactccccaaagtaagtgtcctctccccaaagcaagctttgcagaaacaatgaggccaaatcaccataagaatagcttgtgcaggcggggcatggtggctcacacctgtaagcccagcacttttggaggctgagggaggcggatcacctgagctcaggagtttgagaccagcctggccaacatggcaaaaccccatctctactaaaaatacaaaaattagacaagtttggtggcccatgcctgttaacccagctacttgggaggctgaggcacgagaattgcttgaacccgggaggcggaagttgcagtgagctgagatggcaccactgcactccagcttggtggacagagcaagactctgaa

SEQ ID NO: 259908 - DNA, 150 bp, Homo sapiens
  misc_feature (2)..(2): n is a, c, g, or t
  misc_feature (147)..(148): n is a, c, g, or t
  misc_feature (150)..(150): n is a, c, g, or t
cncagggaggccacttcgatttctagaaacagaaaagctgtagatccacatcaatcaagatgtagatttacccacagatctagagaatcaaggctgccacagagtgttcgacatcatctaattatttctcacttctcatcaaagganntn

SEQ ID NO: 259909 - DNA, 2746 bp, Homo sapiens
actttctaaatcacagtgcctgtggccggatgacatggagggagctccctgaccataggaggggttagagacacgacgcccctctaccctcactcacagcagaggtggaaagctggagactgacacccagtcgcagagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccggtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 259910 - DNA, 1359 bp, Homo sapiens
cgctagtacgaggcctggtgtaatcggcgaggggcgcctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagccgggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 259911 - DNA, 1309 bp, Homo sapiens
  misc_feature (1309)..(1309): n is a, c, g, or t
ccgctgttcgccggcttcccctccccccacacccggggctcagagcaggaggaggaggggccggtgcattctcgccgctgttctttgcaacctgcaggggccggtgtatgtccggcgaggagccggggccgctgcgggtgcgtgcaacccccgaaggagacaatccctccacctcggggcgaacccgggggctgcaagccgcgggcgggcgggcgagcgagaggaagcaacaaagacaggctgcagctggggctggcgaaatggttgcctgtgtgctgcctgtgtgcctcccatgctgctgtgtgctggagatgtgtgctgccctttgtgagctggctgctgtgtgcctgatgcttgcatggcctttgatgctgtggtgccccgatgtgtggatgtgctgcatgctgccgccctgccttggactgttggctgatcaactgtgtgccacctgtgctggacagattgctgtctgcccttgatgctggcctctgtctgctggacccctctgatcactgtgtggtctgtggctgttgaacccacattgacttgagactgtgagcagcctctccccttcagccaccaccgactttccgggaagcggtgactgccacgtgcccggagcagacccaagtggaattaagcgcccagttcaagctggaaacaatggctgggcccccattttatacaccaagagcaccgtgggatagagagacaggcggagtcttagaaaagacacgccaaaaggggaacagggcgctcttacagttctacgaggcggacagggccctcattcgttgtcgcaggcacagttcttcctctgttggacagtagtttggtcgttctttcggggcagcaaacacggccctgcgatcacgggacccggcgggcagaagctggactggtatcacatagctgtgatggcttaccgtcgcgttttgacagcaaaccagcgttttgtgggtatcgacgccgcaccgttttatctcaggagcaaacactagctggaccactgagtattgggaggcagagattgtgacagacggttcaccacggggggaggtgtcaacgacacaccccaaactagatctttctagcaccagagtagaaaatagtccaggcgcacagaaccgcccactgcacaaatagagctttgtggtgaagtgggaaaactcgcacacgtcgccaagaagtgtgtcctttctagagcagtgcccccacagatttggctacttcgggtagcacaccgacttcgtattccattttgaccacagtgcaaactgtggtgacacccctccaaaaggaagcaatn

SEQ ID NO: 259912 - DNA, 2995 bp, Homo sapiens
gcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcctcaggcagcctctgccactcctgcatggctgcgacccgtcgagcggagcgtcgtggtagctgagacctggtgcccttcgacggcctggctgatccgacccagtcgcagagcgcaccccactggggacccccagctcagccatgctggcctgtctgcagaggacccagaacgccccgggccaacacctggcctgcccgagcaagagcctggagctgcgcaagtgcgaggcggtggccagcgccatgcattcctcccgctacccgagcccagcagaactggacgcctatgccgagaaggtggccaacagcccgctgtccatcaagatcttccccaccaacatccgtgtgccccagcacaagcacctcagccgcacagtcaatggctatgacaccggtggccagcgctacagcccctacccacagcacaccgctggctaccagggccttctggccattgtcaaggccgcggtttcctcctccagcacggccgcaccagctgggcccgccaaaagtgtgctcaagagcgccgagggcaagcggaccaagctgtcaccggccgccgtgcaggtgggcattgcgccctacccagtgcccagcactctgggtcccttggcctaccccaagccacctgaggcgcctgctccaccacccggcctgcccgcagccgccactgccgcctccgtcatccccctgccgggccggggcctgcccctgccaccttccaacctgccctccatccacagcctcctgtaccagctcaaccagcagtgccaggccccgggcgccgcaccccctgcctgccagggcatggctattccccatcccagccctgccaagcacggcccagtgcccagcttccccagcatggcctactcggctgcagccggtctgcccgactgccggaaaggcactgagctgggccagggagccacccaagccttgacgttggctggggccgccaagcctgcagggtacgcagacagcggcctggattacctgctgtggccgcagaaaccgcccccaccgccgccccagccactgcgtgcctacagtgggagcacggtggccagcaagtcccctgaggcttgcgggggccgggcatacgagcgggccagcgggtcacccctcaactgtggcgtggggctgcccaccagcttcaccgtaggccagtactttgcggccccgtggaacagtgtgctggtgacacccaccagcgactgctacaacccagcggcggcggtggtggtcacggagctggggccgggggcagcccgggagctggctgggccccctgcagatgccctctcgggcctgcccagcaagagtgtgtgcaacacatcggtgctgagcagcagcctgcagtcactggagtatctcatcaacgacatccggccgccctgcatcaaggagcagatgctgggcaagggctatgagacggtggccgtgccccggctactcgaccaccagcatgcccacatccgcctacccgtctacagataaggcctgccctgcggacatacggacatgcggacagggcgcagagcctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 259913 - DNA, 1659 bp, Homo sapiens
gcggccgccgggctcccagcgcgggcggagagggcgccctgggagcggcgcgggccgagctgcagccttgagcggggccccgaggggaggcgcagcgccgcccgccggacgtggcgatcacgggccccggcgaagatgcgtcgcctgagcgcccgcgcggcccccgtccggggcgggcgtgacccctgctgaacggagacctcccctcccccccgacttcggacggcgcaggccggcgccaggatagccctcaccgacagcgccccttcccacccggagagaggcatcgacccccaaggagggcttcctcaggcagcctctgccactcctgcatggctgcgacccgtcgagcggagcgtcgtggtagctgagacctggtgcccttcgacggcctggctgatccgacccagtcgcagagcgcaccccactggggacccccagctcagccatgctggcctgtctgcagaggacccagaacgccccgggggaggcaggccgcagaacagggtgggcggctcgcaggggcgctcagccccaccctgtgcctgctgatgcccacaggggagccaggctggctgccgcctcgctgtggccggatggagggtggcagggcaacctcacataccaaggcccctccccaccatcggttgccccaggacacagtgagggcctgggggcagccactgacgcccatgccttcctttatctaagctggcagaggcagggagagagaaaccactcaaaaacaggaatggttctttctgggcctcctgggacaggggcccaggccaaggtggggtgcaggaggaaacaggcgcaccagagtcagggtgggggcagggcagcccccccaggggtcaggcagctgtgtctccccacactggctccccagtattctggaaaaggggtacaggaggccgataggaagtcactgggcccaaagtgtctccccaccagccaggtgaagaccactctgacagaggctccagggactataccagtccccctgttcctccttcccctacccccaccattccttcctaacacagagttgcacccccatccccattctccaaaccctggactaccatattcccccttccctccaatacatcttatagggctgctgggtacagttgttcaggctgtgcactgcacaagggcaccttgtccaaggagacaccactttcacccaaacttgtatatttattacaattttctgcatcttgaggaaggggcgtcattttcctgttcgcacaaaggcaccacaggggctaacagtgggcctgcaatcttagatcccatccttgccttcttcgagggatctcttgggaccctcctggttttaactgggaggcccagaccaactcctttcctgcaaaccaccctccaaggcctgtcccacacgatcaaggcagggaaagataggcaggagtcccctcacgaagtcctcaagtcctggcccctctggcgctctggaagcggtactgtatctctctccaaggcctggtcaagcactaagtgcatttacaaatctctgagaatgttttttttatactaaaattgaccattatattctactgtgagaagtgcagtctgcactatattgttttaaaaacgaagagaaagaagaaaaaggaaaacacagatggtgtctca

SEQ ID NO: 259914 - DNA, 828 bp, Homo sapiens
ctgctgccctgcggggcacagatctctgcccttcccattcagggtaaggagctcaggcagcgacagggatctcgggtcagggcagccttgatggcccattggggctgggctcagggtgcagcatggatcaaggttcaagagccccttgttctctcaggaaagccatcctgacatctcccctccaggggggctatgaggatgccctgggcgggagacagaccagtacttcagtaacctgggacacccatgtacccactggcatttcccgagcacccctctgtgtagatgcccaagatgaccaagtggggtcttcaggctgacttgcttacagggggccaccaccggccggaagcacagcctgctgcggggcacggagggagtgaggatctcacccagttgggggcatcagggcaggccccagagcagatgacccagatgccgagcagggccggggcatgtgtgatccatcagtccagcccccactcaagagccctggattctgtcccttcccatgaggccacagatgggcctcttgatgcctcaggccttggtcccctcattggtcgaataagggaaatgggtgtctgctttgagagtctctgatgttcttcggggttgcagggagactcccggggggaatggtgggaggcgaacacggagcagcccccaagtgacagagcaccccatcttcctcctgcagggacccagtcgcagagcgcaccccactggggacccccagctcagccatgctggcctgtctgcagaggacccagaacgccccgggccaacacctggcctgcccgagcaagagcctggagctgcgcaagt

SEQ ID NO: 259915 - DNA, 337 bp, Homo sapiens
aaatatgggcttggtggtgcatgcctgtgctcccagctactcaggaggctgaggtgagagggttactagagcccgggaggttgaaactgcaatgagctgtgattgtgccactgcactccagcttgggtggcagagtgagactctgtgtcagaaagaaaagaaaagaaaggaaggcagttaaaagaaaagaagaaagaaagagagagagaggaaaggaaggaagaaagaaaggaagaaagagaaagaaaggaagagagagagagaaagaaagaaaaagaaagaaggaaggaaagaaagaaagagaaagaaagaaagaaggaaagaaagagaaagaaag

SEQ ID NO: 259916 - DNA, 162 bp, Homo sapiens
  misc_feature (161)..(162): n is a, c, g, or t
aagggaaagattagggtcaagagtatgatttaggagactgtgcaccattcatatgcaagtggatgcacaattcctgaggcagtgccacagggagggatggagaggctggactcaagagtcagtgcaggagaatatctaaacttggtgcttgagcgatggcnn

SEQ ID NO: 259917 - DNA, 453 bp, Homo sapiens
gacgtcaaacgaggtcctgtccccgtggaactcacacgctaaatgtaagcaaatcatagcaagcctggagatgctccaagaggtgctggatgagttagaaggagcaattccttccacttagggaatcagataaggcctcacaaagatggcaatgtttgacctaagacctcggaagatgagtcctcagatgggaagggctcaataagcagagttgttacacaggcagcagcctggcaggagcaaagccacagaggacatgtggccccagtgggtctgagaaacccagaggacattggggtgagggagtgactggtgtagaagctggaagatcagagttacatcatgaatttcaggggccctaggcactttagccttcacggagctcttgctccattcaaaaaaaaattaatgttatgactatgttggtataaagatgaatgtaatccaggctga

SEQ ID NO: 259918 - DNA, 187 bp, Homo sapiens
tagagacagagtttccctctgttgcctaggttggagtgcagtggtgcagtcatggctcactgcagcctcaacctcttggactccagtgatcctcctgcctcagcattctgaggagctgggaacacaggcatgcaccatcacgccttacttagacgtttatattatgattttaagaagtttgtcttat

SEQ ID NO: 259919 - DNA, 1213 bp, Homo sapiens
ctattctagagggtccccctggatatttctggagtgggataaaggcccagactccatggtggaagttaaagggtatttccaagttaaggctaagacttgcttttctaactaagagaatgtgctcatgcattgcttgtgtagtagaaactagtttttagaaaagaaagcaaacttaagaaacactgactcctgtggagatgacttggcaccactctcctttcacagagcagagtctgaatggtcttcagagataggcctgtgggccagattgccatcccctatggaccagaagccaaggatctctctagtgatggtcagagggcccaaatggcagggatacccagtgatgtcaggaggaatagtacagacagaaggtgctaagcagacaattcaactgccatgttttgccaccccctgtgagcagggattaggtgttcaggccagtatcttgggcatgggggagcctttggccagaagaggtataaagctcagaagtttttcagtctgataactattgatataatttccatagtgtgagggagcggtatgctctacccttgtgtatttaaggcaggacagagaaattgaggatgcccctggggctagatcgatgatatgaccagaaatcaaaaagggaatgcattatttattgctgtgtaacactgttaagagaggaggtagttaagggatggataggcacatagagagggaaggtctcaggagaagggatagaaaggaactatgttcacaagaacaacggcaagacagtgcctatactgcctctacagttaataggaaaaacggaagaagttacccttaagctaggatgttgctcagaagtgaccatcccaactttggtgcgggcacaataaatcagcctaaatgtccctaatttaacccagctcattataatgtcattaaacatgacattagcattgtggttttagcacccccatgggttttgcttaggcactcatgggtaataaccaagatggagtccctttggcaaaacttaggcatgcacagctgtagtaccccaagaagaaaatgttacttctctcatctgggcaaaacccacagaagacttcccagcttctgccacataaaagacacagaacacagacgccttactggcaacctgctttcaagacccctgtctttgctgagagctttcctttttcccaataaattctactctgccctaaaaactctc

SEQ ID NO: 259920 - DNA, 281 bp, Homo sapiens
aggggaacaaagaaggtgttaatcacaaagcaatttaatttacataagcaaggaatatattaaacatctatttagaaatcatttgcatgaatgttcaatattcactttatttccagagtcatccatatgtaatctggattacttagaggctgtcacgttagccaacattaatgtataatgaaagcgcatcagtttaatataagcatccacaagtaactcccttagtattgcagcaagctcaatgttaactgcttctcccatatggtcacttgtggtcgacg

SEQ ID NO: 259921 - DNA, 191 bp, Homo sapiens
tgaatgtttttgtggctagagcctagattatggtggtttacggactccagcctgtcacttgcctgaggctgagcctcagtttgaccctctagaaaatggaaccacagcaagtacctccacaggtttgccaggtgggcatgaatgaagcaggggagcccagcaagagtttgtcagtttcccattggcaaatc

SEQ ID NO: 259922 - DNA, 399 bp, Homo sapiens
tcctttcttcagagtccgttgccacaattaaagaagaaacagctgcatttcaaagggattccgattccagaagcttaatcgtgattgacatgttcttattctaagctataagacactctaagagtcctttcttgggttaaaacttcaatcattttctaaaaaattatctcactatggattttattcattttctttgataactattctttgcattttttaacttgaaagatgctttgcgtttgcagtgaatatgagcaactacttccagtgaaagatttggatagtgtcagaccttctctagatgcaaaattgctaaattcccttttagtgccaaaatatgattatgaaatctgatgtctatcacataggtaattattcttcaataaactcgaaaggtta

SEQ ID NO: 259923 - DNA, 708 bp, Homo sapiens
aactcctggactcaagcaatttcttcacctcggcctcgcaaagtgctgggattacaggcatgagccaccgtgcctggccttaccagactgttttccacatgggtccctaacactgctgcccctcactaggcaggttgcgcaacatggacctccagccatcccctagttggactctcaggctggtaacagctctgtagtttcctgggacagagttcccagagtgagaagcaggccatcatttttgtctttccacagccctcgcttctgttgccctcaggctcaggagagagtgtaaggaatggaggttgacatgaacttccagaagagtgcccatgttcagctttgtaaatatcaccaaatcctgttccaatataagtacaccaatatacttaatacgtgactacaacagtgtgagatctccagttgctctatattatttcaacacttgatgttttagttcaaggggattttaaatgaaaattagtaaatggatcatgaggaaatatccagttgctatttaaaagaggttttaaccagaagttttggcaaagttttgttttgttttttaactactattcttgctgttttttctattcttctgttttttcttttgaatagatttttcctgccattgaagaagtggaaaaaagactgggtctatagtacgttcagacaaatcttaaacaaaagttaacatctgtgattctc

SEQ ID NO: 259924 - DNA, 432 bp, Homo sapiens
tgtgttttgttgcacgattttttggttgtttatttagttggctttttggaagacaaatttggaaaggggacctacacagaagtgctgacccacccacattcccttattatcattacagacaagaaggaattagcagagctaagaatggagtgaagaaaggcagtgtgataagcaccagcaaagagttgagagctgttgctctctaaattattatttgattattttaaaagtatggaagttttctagtcactgaagaaaggaggggaaagtgcacttatttttatatggagttacttaactaccacctaaacacatatgtggaaattgtttttgctggtgcaaagtattttaattagcaagaattcatatattgagattataattagagagctcaattcatatatttgctatcctgctcaagcctgacatggc

SEQ ID NO: 259925 - DNA, 553 bp, Homo sapiens
acatattatgcaaggtacttcttaggtgatttcctatgagagcaggtgctaacttgttcatcatacacaggctaggtttacaatagaaagtttgtagcaactattctaaactgaactctcacattatcttgaggaatgtcttcaagaagaaataaaatgtttatccaaaaaaaaagtttatcttaaatgtagaagtctaaataataagcagtacagcttctagcagggagatgggtcatgcatcttaaaatcttggtacatggctgggcttggtggctcatgcctgtaatctgggcactttgggaggctgagataagaggattgcttgacccccatgagttagagactagcctgggcaacatagtgagactccatctctacacaaaatttttaaaaattaactgggtgtggtggcacgtgcctgtagtcccaggtataggagggtgaggctagaggattgcttgagcctaggagttcaaggctgcagtaagccatgattgcaccaccgtactccagccagggtgacagagaaagacctgtctcttaaaaaaaa

SEQ ID NO: 259926 - DNA, 166 bp, Homo sapiens
acatattatgcaaggtacttcttaggtgatttcctatgagagcaggtgctaacttgttcatcatacacaggctaggtttacaatagaaagtttgtagcaactattctaaactgaactctcacattatcttgaggaatgtcttcaagaagaaataaaatgtttatcc

SEQ ID NO: 259927 - DNA, 1894 bp, Homo sapiens
  misc_feature (9)..(10): n is a, c, g, or t
  misc_feature (14)..(15): n is a, c, g, or t
  misc_feature (17)..(17): n is a, c, g, or t
  misc_feature (23)..(23): n is a, c, g, or t
  misc_feature (39)..(39): n is a, c, g, or t
  misc_feature (43)..(43): n is a, c, g, or t
  misc_feature (45)..(47): n is a, c, g, or t
  misc_feature (52)..(52): n is a, c, g, or t
  misc_feature (61)..(61): n is a, c, g, or t
  misc_feature (69)..(71): n is a, c, g, or t
  misc_feature (77)..(77): n is a, c, g, or t
  misc_feature (79)..(79): n is a, c, g, or t
  misc_feature (85)..(85): n is a, c, g, or t
  misc_feature (89)..(90): n is a, c, g, or t
  misc_feature (94)..(95): n is a, c, g, or t
  misc_feature (99)..(99): n is a, c, g, or t
tgagatagnntctnncnctgtcncccaggctggagtgcngtgncnnnatctnggctcactncaacctcnnnctcccngntcaagngatnntccnncctnagcctcccaaagtgctgggattacaggcatgagccacgactcccagcctgaaatatagattttaatcttcagcttgcattttgttctaaacaacttgttttcaataagaacgggcagacaagtttaagccaccatttgttggagcagatcatttattggtgtgttcagatggtactgtactagccttcctcttcccctccatcctcctagccatgtgcagggaattttctctttttgttggttaacactcttcctcatctggattgccttcaactatgtgacaacgaagaattcaagcaccaaaatagcagcagctacatatcctttgcatgacagtgtaatttcttctgccttaaggctgtgtctagcactgaaatcatagtctgtttacttcgatctggtgctacattacaatgggagggatttaactcttacttataaacacacaagggaattatttctcagctctgtttagattagaattagagatgaaattgtgcagttcttgttgctgctgagccaatcaccccattgagcaaaaacttaccttcctactttactagacaagcaagaatactgtgctgtcttttaaaatgttctgcaatataactattagaaccaatacagaaaatttttggtggctagtgagtataggcaattaatcttgaaagtttcccacttgacttgaatgtttgactttctcttcagatgctttctgctggggaaggagcacttctgaattaaagaattttgcaaaagaaaatgtggccagggatattatgtgcgtgtgtctaaaactggggattatcagtacatgctaagtgaatatgaggctttataaaccaatattttaaaatttcatgatcagaaaaagtaatctttaacaccattctcttacccgtgatcgcttagtaatcttcgtgtctatgaaattctacctctgaaatatctcttcagctgttcccttctctctattcccaattttatcttttagatcctattgtctcatctgaatttttagaagagcctactaatttaatcttctgcttctgatcctttccctatgttaactttctaaattatgaatataatgtcacaatttggctcaaatgtgattttaaactataaagtaatttaaactgtaagtcatataactagtttgatgataccgtaaaggtagatataagatattaatactactactcagagacccatgaatgtatctcagtgcctggcacagaataggcacttgataaatatttgcttaatgattagtaagctttccatcgttgggcttatgagaagccaacatttattgagcatctcctttgtggcacatgcgtcaagtctccagcacttgcttgatctttagctaacactgttgttttaatgattttctcaatacaatacttctctgtcttggtaaaaataataaagcaaagaaaataattcatttctgaagttgctttccttcacttgtaaaggtctgatctcctcccactatgcatatgtaccctttactgttaaggaaagctttgcatatgtagatatagaagaataagctacgtaaatactaaagatatgtcattctcccaaaggagacacaggtggttttcaatgattccttgcctcatgttgatgagtctgtagaattcagaacccatttggacacagctaatatccctgctcttggggtagaaaataaggacaccaagtcattggtagggaggtacaggcccttcctctgctgctgcagagagagaatgactcaagaaaattgggctaaaatttgttt

SEQ ID NO: 259928 - DNA, 439 bp, Homo sapiens
actttcagacaaagccacggcggtcccgcggccccggccgcctgggtccggatcgggaaaaacgaggggctgggtcctccctactcggaccccatatccccagcacgcgagaaagagcgagaagccacgcggcggctgggccgagcgtggggtgtcggcggagacaatgaaacttgcaggcgcacaaacaaggcgctgagcgtgtttcttgacaacgtgccagcagcgtggagaggctcgccccacaacagcccctcgtgttgtgtctagcaggaaaacagccgctgccgtttcagacgcagcctcaacaaagagcacggccgccactccagcatgagagcccctgggcggaaaagtccaccaagtgactccgcgcggcgcggcccggccagcacgtttccccggactcgcgtcttctggtgcgcgcagcccgcggccg

SEQ ID NO: 259929 - DNA, 167 bp, Homo sapiens
gaccacaaagccattttaagaaagaaccaaactgaacttccagaaatgaaaatttactacaggaatttcagaatgcaattggaagtgttaataacagaatagatcaagctgaggaaggaatctcagaacttgaagactgctcctttgaatcaatgcaggtagacaaa

SEQ ID NO: 259930 - DNA, 833 bp, Homo sapiens
tactttctacatttgttttatatttgtctgtaaatatacatatgtatgcatgtacatagtatgtacatgtatataaaaacatttttccttaaccatgaagattatttgcagacaccctgagtattccttcctaaatacttcagcatacattttctaagaacaaaaacattttatttcttaaatacaattgtcatatttaggacattgaatattgataaatatttatatacatatacacttaaaaaattttttttatttaggagatgggatcttgctctgtcacccaggctggagagcagttgctcaaatcactgcaactgaaccgagacttcaactgttgggttcaaatgatcctccccgctcagcctcttgaatagctgggactacaggtacacagcactgcacttggctaatttttaaatatttttgtagacacggtgtctcgctatgttgcctgggctggtctcaaactcctgggctcaagcaatcctcccgccttagccttcgaaagtgttgagattacaggcgtgagccactgtgcccagccaacatacatacattctatattcaaattgccctaattgtgacaataatgtgttataacttttttttagatctttgctgttcaccttcaagctgaggacttaccacttttcttcgattatgaaaaatgctcagccaatagctattcattaaacaaatatttatgaggtgtcaacaactgattgttaatgttctagggtgatacaatgcttatcaaaacatgagtttctaccttcatggttcacactctagtcagggtcaaacagtaaatacacataacttatgtagta

SEQ ID NO: 259931 - DNA, 608 bp, Homo sapiens
tactttctacatttgttttatatttgtctgtaaatatacatatgtatgcatgtacatagtatgtacatgtatataaaaacatttttccttaaccatgaagattatttgcagacaccctgagtattccttcctaaatacttcagcatacattttctaagaacaaaaacattttatttcttaaatacaattgtcatatttaggacattgaatattgataaatatttatatacatatacacttaaaaaattttttttatttaggagatgggatcttgctctgtcacccaggctggagagcagttgctcaaatcactgcaactgaaccgagacttcaactgttgggttcaaatgatcctccccgctcagcctcttgaatagctgggactacagatctttgctgttcaccttcaagctgaggacttaccacttttcttcgattatgaaaaatgctcagccaatagctattcattaaacaaatatttatgaggtgtcaacaactgattgttaatgttctagggtgatacaatgcttatcaaaacatgagtttctaccttcatggttcacactctagtcagggtcaaacagtaaatacacataacttatgtagta

SEQ ID NO: 259932 - DNA, 386 bp, Homo sapiens
cacttatatgtagaattgaaaagagtagagcacatagaagaaaagagtagaatggtggttgccaaggactgagggggtggggaaataaggagatgttggtcaaagggtttcagttatgcaggataaataatgtgtagagctaatgtgtagcatggtgactataattgataataatatattgcataatggaaatttgctaagagagttcatcttaaatgctgttaccacaccaaaaaatggtagccttgttaggtgatggatatgttaattaccttaatagtggtaataatttcacaatgtatacatatatcaaaacatcacattaaatatatacgtaatgtcccttgacttttgaagacagctatgatagatctcttgagtttatt

SEQ ID NO: 259933 - DNA, 414 bp, Homo sapiens
tccatcattgttaataaacatgaaatttcaagcttatagttacaggagagacggtgttgatgcggttagaatatggaataggctatggggatttcaaggtcctattttcagctctgcctttgcttcattccagttttgattaagatatttagttttcttatacctgtcttacccgtttctgtagaaatagagattctgagaaaattcttacctattcaatttgtgaagaaaacagtataggatataaaataaaagttttcttaaaaatgtctttacagaccaatgaattttttatgtaatatagtgactataagagaagagaaagataatttattttgtctttatcattatttccgattttttaattttagtcctgctggcttagtatcgtgagaaaatgtgttctaaacccca

SEQ ID NO: 259934 - DNA, 508 bp, Homo sapiens
aatgaaaacttcattttcgtatttttcagattggcatcctactaatttgacccttagtgatgagacttgtcagagatccaagaatctgaaagttgatgataaatgtccatctgtatcaccatcaatgcctgaaaatcagtcagcaaccaaagaactgggacagatgaacttaacagaacgagaaaagatggacactggagttgtacttctctcagggaatgatactctccatgacctgtgccaatcacagctaccagaaaacaaagagagcaaagaagcagaacaagacttggagctgacatcagaggaagagcaagaaagacttaaaggatgcgaaaataagcagccacagaaaacgtctcaagaaccagaaatggctaaggattgtgatagagaggatatacctatatatccagtacttcctcatgtgcaaaaatctgaggaaatgtggattgaacaaggcaaattagagtggaaaaaccaattaaaactcgtcataaatgagtta

SEQ ID NO: 259935 - DNA, 519 bp, Homo sapiens
ggtgagcagcaggaggcatgtagagaggatgggcagttggggagcaatcctctctcattcccagagggagcgtggctggtttacccaacacctaacgaggtcagcaaaggttgcctctgggttctgactccgtctatttttcagcttctgattttattcttaaattctgttctgatgagctgcagaggaggaggcctttggaagtaagcatttctatattcgcacctgtctcctttttagaaattaaatgcaaccatttgtcatatcttaaaatcagtttagggtttaattggccataaatttgatcatattttgccttcatactctagacacatagaaattattttctaaagtatcatttttttttaaaaaaatgtaatactgctcaaaatactatgatattatgctcaagactttcttataaatgacgtcctaaaagaatggcagcatttggcactgcttgttttttatccctacatttttatactgccttgggacatgacaattattatttaaatc

SEQ ID NO: 259936 - DNA, 1313 bp, Homo sapiens
  misc_feature (1303)..(1306): n is a, c, g, or t
  misc_feature (1308)..(1311): n is a, c, g, or t
  misc_feature (1313)..(1313): n is a, c, g, or t
cccgcgctccccgtcaggttcaaagccccctcccgcctaacgtcttcagcccagccaggctgcccttcttccctgcggagggagggcctgggcggtcgcgttggcgggagggaggttacctttcccagtctcgctctggccgcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatgagcacaatgacatttttatattacagagcttccatcatcatgaagaaaaaaaaatttggttctcaagtgaacaaacatataaaatgtaaacaatccctacaatccagataaaacagagaagactgtgattctagcatattatcagaaaaagtaactatggcaaaaaatgaaactgctttaaactccaaggcagaaattgtatctttatagctaaccatttagtaaataaatacattacatttttgtattttagtcatttgtttttattacatgtgattattttaaaatttgattatgaaacctgtgaagtgtgctcttccatgatgttgataggtgaccactgttggtatttacattaaatgtaaagaaatgtgtactgannnnannnnan

SEQ ID NO: 259937 - DNA, 1174 bp, Homo sapiens
cccgcgctccccgtcaggttcaaagccccctcccgcctaacgtcttcagcccagccaggctgcccttcttccctgcggagggagggcctgggcggtcgcgttggcgggagggaggttacctttcccagtctcgctctggccgcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatatatgagcacaatgacatttttatattacagagcttccatcatcatgaagaaaaaaaaatttggttctcaagtgaacaaacatataaaatgtaaacaatccctacaatccagataaaacagagaagactgtgattctagcatattatcagaaaaagtaactatggcaaaaaatgaaactgctttaaactccaaggcagaaattgtatctttatagctaaccatttagtaaataaatacattacatttttgtatttta

SEQ ID NO: 259938 - DNA, 495 bp, Homo sapiens
cttctccagcttcttcaccagcaaccagaagtgccagcttaggctcctgaagacgctggagacaagtaggagccatgacctggaggctgtggttccacagaatgggtctgagaccgggtgggcgaggaagggcctgggcaacacctggccaggggcttcaggttcagcacagagtctagacagactgggcatcatgggggctgggttgggagcctgaggctcagtttccccactagaggtggcgctgagacccttttcgtcgctgtttttggcttgtggaatgaatttgtctgcccttttttgtcactcactgttgtgacagatcctccgatttcttacataagttatgcagccacactgtgacttcagggtaagggtgaggccaagttttaaagtgccagccaggttaattaaggcacacaaaggctgtaaaaatgtaaaaatgtaattaaggcataccaaggctgtaaaaatataaaagcagttttgcaaacc

SEQ ID NO: 259939 - DNA, 427 bp, Homo sapiens
cattctcccttctctctccttctccttgggcttccctactccctgagacagaacaatgccaataaataacctttcagtggccttgatgtattcaagagacaagaagaatagcatgtctctcactttaaattaaaagttagaaataggctgggcgtggtggctcacacctgtaatcccagcattttgggaggctgaggcatgcagattgcttgagcctaggagttcgagaccagcctgggcaacatagtgagaccctgcctctacaaaaaatacaaaaattagctgagcatggtggtgtgtgcctgtagtaccagttacttgggaagccaaggtgggaggattgcttgagcccaggaagcagagcttgcagtgagctgagatcctgccactgcactccagcctgggtgacagagccagaccctgtctc

SEQ ID NO: 259940 - DNA, 466 bp, Homo sapiens
cattagttaggggctttctgggcaaagggtaggagtctggttaggagcaggccctcccaaagaagatgaccatgtggtggttctcaaccccaaccacacatgggaagcccctgaggagtgttcaggccccatcgcatttagccagacactagggaaatggggtatcagcagtttttaaaagctcccaggtgattccaatgggcactgcatacctagactctgcagaggagtctgcacctgaggccagacactcgcctaagcccacactccttcatataacccttggttctttcagagcccacctaggcatgaatttgaagtttaccttcattttctctacattcacaatgacattactaccccaccgcccaccccatccaagttgtcgagagctgcattgtccagaagagataaaatgtgatacaaagttgagccatatgtgtgattaaaaattttctagtacgta

SEQ ID NO: 259941 - DNA, 397 bp, Homo sapiens
attagcatagccttgcaactctaggaggttttaacttcatcaggagattaattacatcagaaagtggtaccgtctggagaggcttagtcaaattttacagttcttcctctgaaagcctacctagtgtggtggaaacatgatctttgtaggcaaatacgtttgccctgattctatattcttgaccttaataaatggcactaccatcagtcctgcctgtaatccttgtcttccttcctgtccactatttcccaataaaatcagtcaccaaatcctgtctctccctgaaactgttcccatcagcatacaaattatgttctggtatccttcacatccctctccaattaccatgccaattttttaaatttccattcatagatttctacctgtaccaactcag

SEQ ID NO: 259942 - DNA, 763 bp, Homo sapiens
tgtgaaaagatacatgtcaatgaaatggctgactaggaaacttcaagccatttttttctagaaagacaaaataaatgagcaaaaattagatgaattcactttataagaactctggaaaacagtcaaatgtttacaacaaccaagcaagtgaccaattagggaaagcccaccttaaaaatgataggaaattgcatggcaattttacttattcttgctcaatcccctccccatgtggtgtggtgttgtggccttggtatcaaggaagcattacctggttcctgctcctctctcttgaactgcagggagcagattagcactatttgcaacatttcaacctatctatatgctatctaaagaaaagatgtttgtcacatctaactcaaatctgaagcagggaaaagcagtaaccaatgattatgatagctataaggtaaaaacagacccacatatacctgttgcaagagataatggtagcatcattctacagaccatctaagatcctgaggaaaagctgaagtaaaattctttggaagactaagaaattgaaaagcagccatgtattagggataactgagaaagctacatgcagatccagtcaagagatatgctcagaaacattctgaaattgcttaatgctttcaccttggcctgatccctagactcagagcatgcacagctaatcaatgataggctgtcctggcaaaatggcagtctgaaaatactcacagatttatatatataaatatatcacacagcatacaaa

SEQ ID NO: 259943 - DNA, 385 bp, Homo sapiens
gagactcagcgagtctgctctttccattgtcttctgcctgctttattctagccacgttggcagctgattagctggtgcccacccagattgagggtgggtcttcttctcccagtccactgactcaaatgttaatttcctttggcagcaccctcatagacgcacccaggaacaataatttgcatccttcaatccaatcaagttgacactggatattagccatcacaatactcttaacatgaaaatctttcatgtttaatctttcatgttttcatgtttaatctttttgaaattaaaagccaacctctttgattttacctcataatgttcaatagattcccaaaactaaagaagaattgcttcttcataaaagatgcgttgcttttta

SEQ ID NO: 259944 - DNA, 214 bp, Homo sapiens
gcggccgcctactactactaaattcacggccatactggatattagccatcacaatactcttaacatgaaaatctttcatgtttaatctttcatgttttcatgtttaatctttttgaaattaaaagccaacctctttgattttacctcataatgttcaatagattcccaaaactaaagaagaattgcttcttcataaaagatgcgttgcttttta

SEQ ID NO: 259945 - DNA, 462 bp, Homo sapiens
cgctttaatgaaaacaaactttaattatgacactgattctctttcacctgagtacatcagaaatttaagtgttaaaatgtgtttacactagtgcaaaacatctaaagtagatgtatttgagaaggtcttaaaataggaaaacttctgtttattttttcacttgaaattgtgttttgtaccttagtatttcttgtaaatcttttctgaatggaaaaaatgtttcctcttttgcacattttctaatattacctttcttagtagaatattaaacgacaaaagatcatataatatgtatgtgtataattgcaaggatgaagtgtgttcagatgatcaaaaaatttatcagcttatatttctccaaagtggaacaaatactgaggaagacggggagagaaaaagaaactgggaacaatactagagccaaactaaagcaaacaaaaaataaaaatatttcacaaaaca

SEQ ID NO: 259946 - DNA, 228 bp, Homo sapiens
tgcacctgccacccgaggagttccaaagtttgcctcagggatgtggtgtggagcccagagcctccagggtggaccaggttctgcccctgagtcgtaccaggaggctgagcccagccatgcagctcagctgctccagatgcctgagcctcagaaaccgggagacagcgatgtctattgtggattctcgctccagcctgggtgacagggtgaaacgccatctcaaaaaat

SEQ ID NO: 259947 - DNA, 668 bp, Homo sapiens
atcagatctatcatttatggaatgcctaccaggtgcccagcattgtgcttggtatttatcatcactaatttatttattactaatttaattgccaccaaaaccttatgaaaatggatattatccccattctagacatgaggagactgaagttcagaaagattaatgacttgttcacactcatccatttgttgtggtgccaccaggatttgaatccaagtctgactctggaatccatggtctctctactgccccaacacagcatcccagtatgccttgaattttctggaacattactgatttcaaacacttgtcccttaggactcctgagtgtacacacacatatgtcagattatttattctcaattatgtttagaaaagagagtacctggcaggggacagtggctcatgtctgtaatcccagcactttgggaggcggaggtggacagatcacctgaggccaggagtttgagaccagcctggccaacatggtaagaccccatctctactaaaaatacagaaattagctgagtgtggaaatgtgtgcctataattccagctactcgggaagctgaggcagaagaacctcttgaacccagaaggcagaggttgcagtgagctgagatcacgctactacacttcagtgtgggaaacagagagaccgtgtctca

SEQ ID NO: 259948 - DNA, 524 bp, Homo sapiens
gcgagtcacaagacgaaaataaaccttttaatttgtgagcatggtagttcacagatgtgaagaaagtgaagtgaaataattgttccacttccatgaaaaactctgaaaacaaatctaagggtaaaattcaggaaaagtttgacattataatttgctcttggatcagtttttttctcttttctctttaaacatgtatttattgatagtttgaagaaaaatgttgtatgcattaaataaaaatcaaaagaagccaccatactaatgtttgacacatattactaaaattaactacaaatctattgtttttaggttgatttaatatgaatatttaagtaaataattattatgcttctattttaaaaataaggagactaaaaaccagtacaccagcttacaataaacaatttaagagaagtaaaatgccttattaaattatctttataatacccaaattactttaagatactttccttttgactgcagaggttttaattctttcctttcttggcttccatggcaccact

SEQ ID NO: 259949 - DNA, 640 bp, Homo sapiens
  misc_feature (176)..(176): n is a, c, g, or t
  misc_feature (180)..(180): n is a, c, g, or t
  misc_feature (263)..(263): n is a, c, g, or t
tcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaagggcccngagnagagaaggttcttgagttcatgtaagaggacagtcttaaaacggaagaagaaaaagaagcagttcagtctttgggagagctgnctccttgtgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactggtaaga

SEQ ID NO: 259950 - DNA, 308 bp, Homo sapiens
ggatgggcatggatcacacattgtatttctgtctcagctctttggaaagaggggaagacataatcttcctgctaatgttggatattgcattgaaacgccttttgcgtttcttgcctcggttggaagtcacaaagggattgaacttcattttggctgctcctgcttcggtgatggccgcaaaagggaagagaagggtttgtatttttaaggaaggtctccttctttccccacgtatgttttagttgtctgaaatccatctggctctgccagtttccatggaactaaacgtgacaagataaagagtagag

SEQ ID NO: 259951 - DNA, 785 bp, Homo sapiens
ttttctcttttttcatgtcacaatgagctataatttgagctgcttttattgttccctaaagactttggattactctgtatcacaaacactgaaatccaattcgtatttttttggcctttggggaagtggaaccatgggtgtgtttgtcatttttagcagtcattggagtagggccaaagctccaggagatactaaaagtgtctagaattgtctgattggctgttggaattaactgttaaacaaagcagccagtaactgaacaccggagaccttcttgaactccagctgggtgggagaccttccagtgtgtctggcagctctgaactaggacagaaaggtagagattcaaacagtggactggtgacaaagcagctgataaaagcactctcatctccatcctttgtctgggagtctcgccttgccttggaatcacttcctctctttttccctgcactggtttgtgccagcgctgtcctgcctggtcacatttaccagctagcggatgagaaactcagaagtgcggggctcatgttccataatgaattgaatccgggactacaggctgcctgatacacaaatgaattttgttttgtggattgaaaacaggaataaggaaagataagttttggacattgacttagtctactcaatctttcgtaggtaaggtgattcttagagagagttcagagaaagtgcctgggtttatcatttatctttttctaaggtatttgattttatacacatttcatacacattaaacaaaaccagtttttaaagcaccactt

SEQ ID NO: 259952 - DNA, 166 bp, Homo sapiens
cttattttcaaattccacaaggacatatatgccaaattaggttaactttgaacaatatattctgttatggaccaggcattgggttacctgctagggatcccaagatgaatagaaacagttctttgaatgtgaagcactcacaatgcaatgggagctcagtgcaatg

SEQ ID NO: 259953 - DNA, 437 bp, Homo sapiens
tgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaagaaaatgaaagctgcaatagaaactcataaatgaaaaaattatctcctgaccatttttgagagaatgagagacatattctgctcagtgtaaaagtggttattaaagttattttgaaaaatttcattta

SEQ ID NO: 259954 - DNA, 681 bp, Homo sapiens
gagagagctagtctcgagttttttttccagaagccccacccaatagcatttcacttacatctcatttgttagagctgggttttcgtttgtttgtttgtttgttttgagatagggtctcactctgtcgcccaggctggagtgtagtggtgcagttacagctcattgcagcctcaccctcccgggctcaagcaattatcccacttcaacctctaagtaactaggaccacagttgcgtgccattatgtctggctaatttttgtagagatggggttttgccatgttgcccaggctggtctcaaactcctggcttcaagtgatccacctgccttggcctcccaaagtgctgggattacaggcatgagccacaacgcccagccagagctgagttttgagaagcatttctggctggccacattgccacctcaatcagaggggttctgttacaaagtgtcacgggttgaattatgttccccttcctgccctctgccaaatgcgtatgttgtcctaacccccagtacctcagatggggaccttatggggatctagggctgctgcaggtataattagttaagttaggatgaggtcatgcaggagtaaggtgggcccctaatccactatgcctggtgtcctatagaaagaagaaatgtggacacagatccgcatgcagtgagatgatgtgtg

SEQ ID NO: 259955 - DNA, 377 bp, Homo sapiens
tattggttacctttggtggggaatttattggctcagggcagcaatgagagtgagaatttttcacatatatacttttttgaaccattttaatttaaaaccatatggtatataatatcaattcaaaaatttaaattaaagaaatgtacctcctaaatatattatagtcatacaatggaacacttggcaaatcttaaaaagaatgagctatatatcccgatgtacaaaaatctcaaagaaactggtgtggtagtgtgtacctatagtcccagctacttgggaggctgagactggaggattgcttgaacccaggagtttgagtccagcctgggcaagatagcaagacccccacctccaccccacaattacctctaaggaaa

SEQ ID NO: 259956 - DNA, 382 bp, Homo sapiens
gcccgttccatgcgtgccgggggtcggggggttgactcgagttcatcgaacccagcaagcctcgagatccaacaatgggctcggaaatgaggagcgaaaaaggaaagagaggcgcatgggcgtaggggggaggttgactgaacaccctcagaataaaagccagaaaccagggctgggagcgcagatcacgtaacctctacagacaaagcaaagagcccccgaagaaggtgctgggcgaacgcccccagtgctcacgcccgcagcagcaaaacgccaagatttcagcgctgattgtccccctccctttaatgccaggccccgccctgtcctatgaagcccggccacccggtttggcatggcaccgtaaagacgtgacacgccg

SEQ ID NO: 259957 - DNA, 491 bp, Homo sapiens
atacatgggcttgtctcatctgtacagcacccataggaggcaggtctcctcaccccatcctacaggggaggacaccaggcacagagaggcaagagcacaggccaaggtcacacagccagaccctgtggggaagccggattggaacccaggcagcctggcctcagagtcagcactccttatgcagtttcagatccctgtgccttgcagctcctccatctagttcctctcctctgagttccagccacagcaaccagcccttcctcgggacgccccaaagtgaggcggtgagccgccacatcccacagcctccccagagcctgggtctcacttcattgcccaggcaggagtccatggcgcgatctcagctcactgcaacctccacttcccaggctgaggcagaagaatcacttgaacccaggaggcagaggttgcagggagccaagaacatgccactgcactccagcctgggcaacagagcgagactttgtctc

SEQ ID NO: 259958 - DNA, 1125 bp, Homo sapiens
atacatgggcttgtctcatctgtacagcacccataggaggcaggtctcctcaccccatcctacaggggaggacaccaggcacagagaggcaagagcacaggccaaggtcacacagccagaccctgtggggaagccggattggaacccaggcagcctggcctcagagtcagcactccttatgcagtttcagatccctgtgccttgcagctcctccatctagttcctctcctctgagttccagccacagcaaccagcccttcctcgggacgccccaaagtgaggcggtgagccgccacatcccacagcctccccagagcctgggtctcacttcattgcccaggcaggagtccatggcgcgatctcagctcactgcaacctccacttcccaggttcaagagattctcctgcctcagcctcccaagtagctgggattacaggcacatgccaccacggccggctaatttttgcatttcaagtagagatggagtttcaccatgttggccaggctggtcttgaactcctgacctcaggtgatccgcccgccttggcctcccaaagtgctgggattacaggcatgagccaccacgcccacctgacattatagcctctgctttatcttcactgcagagtcaactccagaagaaaacccctactagatgcaagaagaatgggcatcgctaaccagcccgtttgctgatgtatggcccctatactttcgttggtttcctggtttctctttgcaggcaattatttaaccctgtgatggaacaaagcagccaggaagcagtagggttgccgtggttggggctggagtcttagcagtcagcctggaggagctgcgggctcatgtcagcactctgggagaaatgagcaagcttttgggaggaggaaggcaaatccatcctcacccgggctgtgagcatgccactgggctcgaggcgaatggggaggaaatcaaagtgtcagctcgtgttaggaaaccgcacatgatgcttcccagtcctggccgtgcttttaaaaattagccaaataaaaatggttgaagtcatttcagtctgctctttatgactgctaactagcagaaaaacgtgtcctccctggaagcatgggcttaatgagcccagc

SEQ ID NO: 259959 - DNA, 311 bp, Homo sapiens
ttattgaaaaataccgcctaggacttcataaaaatttacttggacaaatcactcttaacactgctaagcctctattttcttttctgtgaaacaggactaatattctaccatacttcctcatagaatcatgaggattaagaaagaaaacttctgtaaaatgcctaccatagtggctgacacacagttttactatgatttgaaagcctatcattaataaatccaaagcgttcctgtcaagagcacccactagacttccaatgaagccatataaaccaaggaatccagccaacgggccctgaaattcttttaat

SEQ ID NO: 259960 - DNA, 567 bp, Homo sapiens
  misc_feature (557)..(557): n is a, c, g, or t
gcagtagaagctcctgctagccttgcaagagcaaactgccatgttgtgggagagggccacatggcaggacacggcaggtggcctctgggatcgagcctctaactgatggatgcagtaaggaactgcattctgccaacaaccatgtgaaccctgaagacaactccaagctccagaaagaaaggcagcctgactgacgccttgatgtcagctttatgagaccctgagcagagaatccagccatgctgcacctagacttctgacccacagaatttgtgtgctaataaatgggtgttattgtaagccactgagtttgtgatcatttgtaacacagcaatagaaaactaatatactgccaggcgcggtggctcactttgggaggccgattttcctctgctcacccccctccgccacccagtccccactccagataaaacaatctgctcacccaggctggagtgcagtggcgcaatcttggctcactgaaacctctgcctcccgagttcaggagaatggcgtgaaaccaggaggtggaccttgcagtgagtcgacagtgcganctccgtctca

SEQ ID NO: 259961 - DNA, 370 bp, Homo sapiens
ttaatggcaacttgagatcaatgctaattccttacataattctgtttagataaaaaaatctgtcccaaagtgctgggattacaagcgtgagccactgcgcctggccacaactggctaattttttatattgttggtagagatggggtttcaccatgttggccaggctggtcttgagctcctgacctcgtcatccacccgccgcagcctcccaaagtactgggattacaggtatgagccaccgtgcctggccccgaatgaaattttaagtatgggaaatatcacatattccagttcaattggatttggggtaccaaagagctaactgcttctttgtacacttggttgctgagtactattaggaaaaacaaaa

SEQ ID NO: 259962 - DNA, 422 bp, Homo sapiens
gttttgggaggaaaacaacagaggcaaaatggcattctcatcacattaaatcaagggtacttactgttaacatgatttactactgtccttgatcccctggctaagttggtgttgccgtatttctccactatgaagttacgcttcttcccttttttcattttgtggtctttagaaggaagtcactatgcaaagctcacacctcatgttccagaagctgcttttccaaggagtgaatatttatcctccacccttttgagtgtggagcatttacttaaattgtttggatttatgctctgcatgagagacttatctattatcttccattttaaaatgtatttaatcatcctatcagtatggactcatgaatatggatattattttatactatgaattatagtccattactactctattttgttgct

SEQ ID NO: 259963 - DNA, 272 bp, Homo sapiens
acagtaaaatgttggtcaatggattgaatcatttgaaagaaaaagaacgtcaatatgaaaaagagaaagcagaaagagaagcttgaagtagaaaatgccatgatgagaaaaacgattaaaaaacagtatgaccaaattgagcggcttgagaaaatcctgcagcgttcaagtttgatgctgccaggtgttcaagagctagatgaaggtatgttgccaaaatttatgaattaaattcaaatcattgatttctgaaataaactgtaagtagtgaa

SEQ ID NO: 259964 - DNA, 446 bp, Homo sapiens
caaagaaatggattcttccttagtgcctccagaaggaatgcagccctgctgacttcttgaatttagcccagtaatatccagtttggacttctgacctgtagcaaggagtaaaaagactttggcgttctcagaagaaaaccaaatgagatcacacgaatgagactgctggagcaatctaatgcaaatatctactacagattatcaaaaggaaaaaaaaaggagcttatatcatagttgagaggttctcaaacacaaactggtgccaaaagtgacaaaatgagaaagataagtattgtgcaatgatcatatctgtgcatggtatggtatagacagctgatttgtaatcagtacacttgcatgattttatgaatttccagtaaaactttgccaaaggaaaccttcattttattgcttgttcccacaataaattagagcttatcagcaaa

SEQ ID NO: 259965 - DNA, 562 bp, Homo sapiens
ttcctgaggccagatgtggaggcttttcttcagaaatctcctggtcagccatgaataatcactactgtgcaagaggatgagctccggcctctcttagtcacctttgagtccatctcagctactgaaatgtctgtcctatggagtgggaggctacccggatgagaagaggaatagaaacagcacaaggaccacgtgaactctcccgtactgaaccatagtacaggtcctacagggaagtttgccttgtttccgaccccactcctgaatgtatgacaggcatttgctgagaacaaaggctaccattaggcatcgcggctgatgctgtgagagtctaaaggatacactttctaccaggaggctttccgcctaggaaaggggagacatgaatctaaatgcactagatgagagagctgtgtagatgcgcgtcttcctcactggtctcagtcattttttaacctcccgcttacccacagtactgcacctggcatgcagatgatgctcccataatgtttggtaagcattacatgcaaaatacaaaagacagttcataggaggaagagaa

SEQ ID NO: 259966 - DNA, 452 bp, Homo sapiens
caaaattctttcatataatcacccaagccaaaagcagcattcagtacgcatgaatcatatgccgtaagcagatgtaattcaatgttggaatcaaataacatatgtttatttttacacatttaaaatatttctccatataaaaaactgtcataatttcattggaaatttttacatcccaatttttagctctatgtacaaccagcctgtttttacactcaaatccagagttggataaaaattaaagaaagattaaaagggtagcagtgttgtatttattactttataagatatttagctagatgacaaatctataatgctattctacatggcatctcatcttgaatggcatttcattttcatagcgtcgatgttgaaagatatgggggaaagggggaaacaggtagaaaaagtaaaatataagtttttgctggcaggcagggtcactattaagt

SEQ ID NO: 259967 - DNA, 526 bp, Homo sapiens
acaatggcatgatcttggctcactgcaacctctgcctcctgggttcaagcctcagccttaagattctcctgcctcagcctcctgagtagctgggattacaggcgcccaccaccacgcccggctaagttttgtatttttagtagagatggggtttcaccatgttggccaggctggtctcgaactcctgacctcgtgatcctccttccttgggctcccaaaggattacgggcgtgagccactgtgcccagcctatcatcattttttaagcagttccagatattatatggattttgaatggaggtttgtggtaagaggtagaaaataagtagtgagttagaggatattcacaaatagtgtaagaggttgaaaacagcagagggagaacatccaaaacagaaaaaacaggctgaatacttttctgtgatgaaagagaaagctgctgatataaagcagtttatggggaaagtttgttgtaaaaagctttaactctgtcatttgccttgttctattaatcagaaaaactaag

SEQ ID NO: 259968 - DNA, 562 bp, Homo sapiens
cagttcgagaatatctctagtcattgcatcttgacacccaaagcattgggcctaagggtcaccctttctgctgtcccaagagttatctctggtcttacctattatttttgagcagtgccttgagaagaatttcagtctgtttgtaggccccactgcagctaattctgtacctaagaccttcagtcttggctctacaatttcctaaaattgcatgaaacaaaaaaatctgtgattgtgtaattgcacattttctagagagaatttccctagttctgttaagcctcaaaggacttagtgacctattcaggtcagagaccacagctctaaccagagagcccagagctgcccctgcccctgcttccatgctacatactaaacacacccaggcattccttaggggtaatattgaactcttggtcatctaggttctgtcaaaattcatctgacatatggttacatggattttgaagaagagagaagaaaaagaatatgaaattttataaataacatgaaaagaacaatataaggccattttcacaaaaataaagacaaatggaatatg

SEQ ID NO: 259969 - DNA, 880 bp, Homo sapiens
gagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccgcaaccaagtgggaggccaggcaaccaagtgggaggccaggcaaccaagtgggaggccag

SEQ ID NO: 259970 - DNA, 268 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(11): n is a, c, g, or t
  misc_feature (14)..(14): n is a, c, g, or t
  misc_feature (16)..(18): n is a, c, g, or t
  misc_feature (33)..(33): n is a, c, g, or t
  misc_feature (267)..(267): n is a, c, g, or t
ggcntncnanngantnnnatcacaggcacaagncactgcaccactgcacccagccacctctctctcatttgtcaccttccagtcaatcagagaagcccaaggtcccaatagagagggtcacaactgccaaaagctttagatatgtcctctaatctccctgacaaggtcatgtgagtattatcatctcctatacagatgaggaaacagaggctcagaggagttaggacacacagcaagcatcaagatattttggtgccaaataattgng

SEQ ID NO: 259971 - DNA, 393 bp, Homo sapiens
ctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctgg

SEQ ID NO: 259972 - DNA, 809 bp, Homo sapiens
atcctgggctggagctgttttttcagttgtaaaatgctgtttattggtgttaggtagcagctaataaggctggaggtggggctgggtgtagtggctcacacatgtaatctcagcagtttgacaggccaaggcaggaggattgctggaggccagggatttgagaccagcttgggctacatagtgagactctgcctgtactaaaaattaaaaaaaaaaaaaataactcagtgcagtggcgcatgcctgtagtcccagctactcaggaggttggggtgggagggttgcttgagcccaggagtttgaggctgcagtgaactatgatcaatcacaccactgcattctagtagcctgagtgacagagcaagacctgtctctaaaaaaaaagaaattttttttaagggtggaggtagggaaattcaaagctacttactagctgtgtgaccttgcctaaactacctccttggatttgcagtctgtttatttgaaaatgtcataagggataaatgagattccttatgtaaagtactttataaatattaagcacttaccaaatgttagtctgttttcacattattcttcttggattaccagaaattggtttgaccatgaataaacaggagataatttcttgggtaatctgagtttgaatcccctttctctctcttactaattgtatgactttgattaggttatttaatatttaattgttctgggtctcagttttctcatttgtgaaattaaaatgtgttcttcagaattgtgagggttaaatgtgataaaaggcctgactcatatgagaaaatgctcaa

SEQ ID NO: 259973 - DNA, 906 bp, Homo sapiens
gagtctacctacctactaccttcttctttcttcctctgctaccttctactctactactatctttttcttcttcttccttatacttcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggg

SEQ ID NO: 259974 - DNA, 858 bp, Homo sapiens
actcatttaactaaaacatgattttcagtttgaatactttaagtttcaattaagaattctgctttttcatggtaagaagttatcgtggatctcctgcacatcattgttctgtgtgtcctacttctaggataaagcctctaggctccttagtatggcacttgaagatcttcatttttctggctcaagctttgtttttttctcatcttcatctctaccaagtatcccacactctggccatatccccgtgactccctatttctagagctaatattcactttcacaagtttttgcctttcctagatgacactgaatttcttcttatccgtcaaggattagcttatgcttgacatctgtagcttcggaaatagacattcactgcttcttttgtatttccttaatgatctgtgcagctcgctgagcagcataccttagtaccatttatcatagacatttgtgtacacctctctctttttctgctgaattataaattccttgagggcaggtctccttgttatttatatttctatctgtatcttctacaatatgcctgaaatatagcaacattcagtaaattagcatttcttgactggcaatcccttacctttcttttgcttcttttttttctttttctttttcttttaatgctcatttcctaacatcccccttacctttcaagaaaggagtactgtcattgtctgctggaagatacagaactcctgttgaaaagtaaatttaggctgggctcagtcgcttaacacctgtaattccagcactttgggaggacaaatcaggagtattgtttgagaccaggagttcaagaccagcttggacaaaataacaagagctcgtctctactta

SEQ ID NO: 259975 - DNA, 313 bp, Homo sapiens
ccccccccccccccagacatactgagccctccggctatttttaacactttgacctaatgtgggctggtccaccacatgtgctggaaagcaggccgcccaccaggaaggcgaggcaggggaggaccctcaggagggggcttctcactcttgcatttgacccgtcacctcgggctgcgtggggtctgtgcacgccctttcctcactactgccaaggcagatctaaggggggcttcctctgcccagggccaagccccaggcctcgggctgtgctttacaggaaagaactttgcggtgtcagccccctgcatccgga

SEQ ID NO: 259976 - DNA, 374 bp, Homo sapiens
cctcaaataattgagaaaaatctgtgagttgacctggtttcaaatgttgctcaatggtggcccaaattcagctggtctcaggtcctcttttctactttattgccaggcacatttatccaatatggtgacctccagcagttccaggcttacatcattcttacagcaacaagtgttattgcaaagatagccttttgccagttaattccaacaactctatgaaaattgagttgtatagttcatccttgaaccaattactctcaccaagggaattacatgctagcttgtggagctggaaacaggtggttgtcaaaccagtacaggacacatggaccaagagtaggagagtagtttactaaagcaaaaaaagtgaaaca

SEQ ID NO: 259977 - DNA, 560 bp, Homo sapiens
aaaactcccctccccgaccttgtcatctagtgtaaagacactgacttgggccggttttcttaaggtagtatttaaggtagtattcttaaggtagtattgctgtttaaggagtcaatagtcttaatttagacgctcctcagcccaaggctaatgcaaatgttttgtcatttatgtcattttgcagaggcaatttgaataacacctacagtaaggcaggcgtgggtttgctagccagtgaaagagctcctctcgcattgttggtcccccagtgctctgtgtcagtggggaatctctccagaaggtgactttatgggggatgtcatgggctgcagtgggtggccagaatttgagaactagcagataacgtcacatacgtgccccatccccatcacttcagccagcatcagatctgctgtccaggatagctatacattacttgtggttaaatgtatttgtcttaatacattaagttaaatatatttgtacttgtggttaaatgtcttagagtaagttccttcaaaagttaattttgagcccttaagttaatgatatttctttcc

SEQ ID NO: 259978 - DNA, 161 bp, Homo sapiens
gttggtttctgctgagggatgtgagggataatctgtttatgcccatttcctaatttctggtagttttctggaaattttggcattttttggattatagatgcattttctggtatcttccttcatgctcacataggattctccctgtgtgtgtgtctatgtct

SEQ ID NO: 259979 - DNA, 424 bp, Homo sapiens
atgaaatttatccactgcctgcatttgctaatttgaaagagttctgatttcatctgccgggcttaatatagaaattcttttaacctgaacagatacacagaaatgtggaatttattcaatgccattttcttgatttatgtcaggaaatatatatggctatgctgtcatctttttatatatagacatcaatatatataaatatatagagtcaagtcagaaattctgaaaccacattgcacttagcccttacagcataatgctttccatattcttcacagtttgtttccctgatcctttagagagagctactgtgtttaaagtgtaaaccatttttacagaaaaaatgtattacaattctatatgataattctcaaagttcaggaaaataatctgaaataaacattctaaattgaggaatgaataa

SEQ ID NO: 259980 - DNA, 511 bp, Homo sapiens
caaaagccacacctatgttttcttgcctacatagttccctttttgccctagtcttagttaagatgttatgagaacaaagcccccaatttttgcctagtcttagttaagatgttatgagaacaaagcccttaatttttggatccctttttgtctagttggaaggatcttagatttgtagcttcagtaatgatgatgcaaagaagctgagaggtgaacttgtagaggtgacacagaaaactagtttaaaactagggacagtggttagaaacaaatctttcagcacagtgatatgaactaagcagaaaacaaaagcaaaggcagttattcctgaaaggtcataaagagcttggttaggaaattgtgggacaagtaagtgtccaaacatggggcttcagaaaggaaagagtgttgtaggcagaataaaaataaatattggctgtgtggaaactttccgaatttgatgaaaactttaacttacagacctaagaagctcaatgaaagaaaaaatata

SEQ ID NO: 259981 - DNA, 207 bp, Homo sapiens
gcgccgcagtttggccaagaagggagggagacggccacgaaataaataaataaaaacagtcgggtctacgtaacgccctgtcgaaagcggacgccatatttttttgtggcttatgtcgacatagggaaacgtagacatgtttttcctcctcctcctccccctcctcgctctggctcccatttatccaaacttgtaatcaaaactctt

SEQ ID NO: 259982 - DNA, 528 bp, Homo sapiens
ctgaccaagaagaatgaggttatgctgacaactggagggtgagcagagcagagagttgtattgagcaatggaacagttttctgcagagaggggacctgaaggagacggccccctacccaaagtcaggtagctccccaaagtgtggctgagtccagggcttttattggctccaaatggaggagtgagtgataattgttttgtgagtatgaaaaaaagatgtaattaaataagggtaggtatatgtaaaatagtgaagagaggggatcaataaaaggaaactgcaccaaacaagaagagaggttctcagtctggtccacggatttatttgagacttgtagcttgcttgtcagggtttaaactgtctgtggcttgaaggctgggtttcactggggacccacctacatctgcttagggatttgactgcctcctgctgtatcaggttggctatttttccatttgtgactcacaagatagtcaatagtctcataatatgttgattgtcaccaatgctaggctgctagtttgcaa

SEQ ID NO: 259983 - DNA, 396 bp, Homo sapiens
gtttaaaatgctctatgttgtgcccaaaagacatttttttttttctggggatatttccagtgcagtaacttgtgtatagacaagataactactttagtgctaggagctttctatatgtgttcatggattcatcgttggcccttaattgtgtgttcaaattttaagtcctctttactttggcatagagacaattcctagggaagcaggtaaataaatactcagtaagcagtaatgctaggggctttcatagtggtttcatggtatattaaccacatcttttattttctgtatcctgatgctttgacatctggggccttgcagaccctggagggactgtcccttccaaggtcagccaatttttttgagataataaagaattcacccacaagcatgcct

SEQ ID NO: 259984 - DNA, 1810 bp, Homo sapiens
gcaataatctaataatacagaaggattagagatacaaataaaaaatatttcatctcttcttcaaagcagggttccttaatacagttgtttaaccatttactgggtttaccatcattcttcttgatgtaaataggatcaaatagaaaatatcagtatacactgcacataacaaaaacaaaagttatttgtaaaactgttacttcagtataaatattcatacatacgggtaaaaggtatctgttaggaatggtttagtctgctataataggatgttttagaaaaaaaaaattttttaaagaacaaaaggaatggtttagtcaaagtgtgataggtacttccctaatgccctcgactaagcattggcctaatctgaataccaacaccatggaaaatttaaaacaatttgcaataaaacatcctaattcagcctttcactacttcacattggcacgcctcctcaatgccccatcctacatcctcacttcttccactcttcttctgtcctctcctagttagttctttaactgcaacccacgttagcctacgtcacacagcagaataaattaatgtgcagaaaatatggatgaaacttctccttaaatctttcaaactgggtaactctacttcttgagacagagaaggatctgcccaagcatgagcaggactaagaaaaaatttcagtttctctccgctttactaaacttagaaatttaagagagagaacgtagggccgggcattgtggctcccacctgtagtctcagcactttgggaggccaaggcaggcagatcacttgagctgacaagtttgagaccagcctggccaacacagtaaaaccccgtctctacaaaaaaatacaaaaattagccgggtgtggtggcacacgcctgtagtcccagctacttgggaggctaaggtgggaggatggcttgaacctgggaggcagaggtgagccatgatcatactggtgcactccagcctgggcaacagagcgagaccccacctcaaaaataaattttttaaaaaagagagagataatgtaaaagtagatattcctgtcaggaaaaaatgaattaaatgaatcaaatcaaatgaacacattttctcctaaattgtgcccagccatcactataataggcttatagtctaaagattttaaagtatattttagtaaggttttgcattcactgaagaaaagcactagcccaggctgttttgaaagatgactaaagtattgtcacctgaaccacacaaaacataagaatttacaattttgttaaccccttttctaaataaggtctcttgtcagagtcatgttgaaaattaactggcaaaacatctgtaagaatagtcatcatcataaaaatcatgctattctctccatacaaagatgaaaataaagacactgccatatgcttcaagtaagtattcaagcagcctgatggttttgcaatgaatcatcactcgctctcctgttcactctggtgatctcccatctgagcggatggcaactccattcttccagatgctctagccaaaaatcttggaatcatcttatcttccctttctctcacatctaatccaacagcaaatcctcctaacttcaaaaaatatgctatatccagaatctgaccacttctcaccatctccactactacttctctcccctggataacctccttccacccttgtgcccttataaaactattcttcatattgcagcctgaggtgtttgtttgtttttgagacagtgtctcattctgtcacccaggctggagtgcagcctaggcaacaaaaggagactctgcctt

SEQ ID NO: 259985 - DNA, 1921 bp, Homo sapiens
attagaagcaatgctacctgttagggtcctccagtagttgtttcttccccctacttcttgagctttgacttctgagattatctgtgtgaaagcccttagcagtccattgaaatcttctaaagtaaggcagttaaaaaatatctttcctgcttagcagaagggactttgttctttggcaccaccttactctttgcaatatgttgctagtagccctaaatcagaatgtgcattaatatatcttttgaattgtttggtctcctcaggagaaaaaaaaatgttttcaacaatcttataatattttgttaaaaatccaattctggttcaatgttttgttctcaaaggaattttgaatgaagaaaaagcttttgtaagagggaggaagcttatctaatctcttcaagactgatgagaagcaatcaggagcttgtgactctttgaaacagtaaatttctagggaattgggcacacgtttctcaggaacaataaagagtgttacacttcaggttggctctaaatgcaccccttcatgtatcccaaaaggcaatttgaaagcaccgttctctgagtcaactggaaaagggaggaagccatgctgagctgagattctttcagggggtcaagagacactgaatacagaatgaagatcactcttctgattactgtcgaattctcagttataacctttttaataaaatgtcttcaaagatgtaggaaaataaattggctcagacaagagagttactggatattagaagatttagatttttgacaaggtcttctacttgtttgcaaatgtactatcttgaccatataaaatttgcctaacctttgctaaaatttcactgaattgttctttgcttacattacttgatattttaagactttgttagataatcaataagtgatagatgtgtagcattgttactgttgccatggttaccatcagtgttctcttcccttctctaggttagggttggcaggtacagctatgaacctgggttccacatctaaccccacatctgctcatcttcttgtagcactggaaagtgtgaggggcctgactagactctggctgctcagtagttaacctacactcatctcacctgaaaaacttgtcagtgaagttttagtcacaagccttttagaagatagaaaaacagtttgcatggaaagctctcatttttaaataaaaactgattatatcaagctaagtgagactctctaattgatgacataatactgtctacgttatcattgcttaccactagcaaggcagcaagtataattggaaggaaagagtatggggctatctggagacttgattcaggtgttgtcagttttgtcttaacatcattttccttatctgtaggggacactttctcctatcttaatgacacatgcagaaaagtcaaatgatatatgtgaagcattaaatatttagagttccatggaataaggctagtttataaatatcatatattacaatagaagtactagtggaaatgtaaatcactttgaggtctcaagagtaaggtcctttatctgagttcttagtggttggaaatttgtttttgagtcatcatatagggaagtcttctgttgctactaaatactgatcatgcattggaaacaatgaagaatgaattgctagtgatatattacttcttttaaatagttgctttaaaagcatttgttactataaattctctgagaagtttctctcaaattaaaaaaaaaaaaaaacttactgttatgtctcccctatgatagtcagtgactttctggagggcaaaaaaccaggagtacctcactgattttctttcttggtcaccaaagctggtaccagataggtcttcagtgtttgttgagcatcctgtgtaaaaatttagtaatacttttagtaaaatttgtaaaaaaaaaa

SEQ ID NO: 259986 - DNA, 675 bp, Homo sapiens
gacctagaggatcccctctctccacactggtatccctctctccacatcctctccagcccctgttgtttcctgactttttaatgattgccattctaattggtgtgagatggtatctcattgtggttttgatttgcatttctctgatggccagtgatgatgagcattttttcatgtgtcttttggctgcataaatatcttcttttgagaagtatctgttcatatcctttgcccactttttgatggggttgtttgtttttttcttggaaattagagatgttaaagtgtgtgtgaaggaagctcctgagggcaggagtggggtgggggtggggcgacctgatgtattcaaataactgaaaggaaggaacgcagtgtgagttgtagagcagagcagtatgaggagagagtgataccagatggggtaggagaaatggacagggcaaagatcatcctgtgaggtaattccagtacattaaaaggaattgacttgagtgtagtgggaagccatcctcagggtgctatttggagaatatgttggtgagggcaagagtggaagcaaggtgttcagtgaagagggtagttgtaatagttcagtattagcttggactagggtggggcagtgatggagagaagtggacatatcagcccaatttagtgatggcattggatgggatgggg

SEQ ID NO: 259987 - DNA, 315 bp, Homo sapiens
acatggaatgcacagattgcaagagagaaacataagcactattccttctactccaatcccttgcagccagtgctcaaattttatgccagcaggcccagagtcctaccccttcctcctgaccctctagagtccctgatatggtttggatgtgtgtcccctccaaatctcatgttgatgtgtggcctccaatgttggaggtgggactgttgggaggtgtttgggtcatgggggtggatccctcatgaatgacttggtgctgtcctgcaataatgaatgagctctcgctctattagttcacacaagagctggttgttt

SEQ ID NO: 259988 - DNA, 337 bp, Homo sapiens
ccagtattttcgtaataattattttgtataaatttgaatataagtttaatattgaataccatgataatatgtgcgtgtgtgtgtgtgtgtgtgtgtatactatttttctgatcaaacaagtgtttccatgctcacacagaaaaactattaccaggaggagagttgagtataaaaaacgtgattcagattttaattaaacaaaggaaataattttttaaaatgctattaagtgtaaattgtatttctcttaatatgtagttagtatttaatcatttctatatataatgaagttttgtggctaggtttcttcattgtaaaattactatttttttccatt

SEQ ID NO: 259989 - DNA, 483 bp, Homo sapiens
gcagggaccatttgctaaatctttgctgtctctcagcacttagcccagttttcaaaaactgtgagaagagtagacatttggataacaatgatgcctaagtaaatctatccaaaaacatttggctcagatgctaacctggcaggcccaggctgtgggtcagtggtgggaaggccaggcatgggggctgttgctatcttgccagagtgtggatgagacctgaattctgaggaggcagagaaatcctagaggccagtggactcagcaacaagagttgaagaatcaataggtaccagttgagcctgacttgatgtttcaccttgagctccatcactttgattgcagatatcgtcatattttcttttagaattcctgttcttcaaccagcagtccatttctttttttaagggaaatgatttcacttcatctaaaataaataatatgtataaatattaaaagttagctaagaacacctacaacttagtt

SEQ ID NO: 259990 - DNA, 430 bp, Homo sapiens
gatgtatggttaaatataaggaccatctctttatcttctgtgtaggctgaccctagcacagcttctgcctagtacatttccacctagaatttgtggattgataatgaatgaatgaacaaaaaatgtatcaacaaatgactaaaaggacatactggcagagtccttcaaggctgttaggacaaatttaaagtgagtgagttattgtcaattatgtgaacaaggtaatccatgtttctttaaactcataagtagcctttattcctcccactgtatctttaatttgtaaagagaggggatagacttttgtcatccaagaagcccttcttctgcacaaaggatgcagttaatgtcataactttacctctatgcatgtcttaaattggaaaagccattcatatatttcatataccctcaacaactgtgagatttt

SEQ ID NO: 259991 - DNA, 332 bp, Homo sapiens
aggtccattcaagtgggcattatgcccattttagagaggagaaggtggagtctcagaaaggttaaaaaatttcccagagattccacactggaagaggtgatgtcaggatgtaaatctgtgtgttgtggaagattaagtgcctggatcacagatgctgtcaccctttctgatcacaagggctcccctgtgagtggtcattttaggaagggatgtttcctgggagagacggggctgcttctatcgttttgatgctgatatttttgcctcattgacttttcagtaatgggattcttaaaataagcagtcttcttacctcatcctgctgccttcct

SEQ ID NO: 259992 - DNA, 464 bp, Homo sapiens
ctgcaggagctatgattgtgccattgcactccagcctggctgacagagtatgaccctttctcttaaaaaaaaaagattctattttctctttgcctgatgctttagcacagaagcatgttccccttccgtatttctccaactagagtgaactcatcctttaaagcaatctggcatggtgtcctgtagtgaagcagaggatcataacataagtaaactctctatgggtggaagttggagagaaggacattttggctttgtacatgaaaagactctccagatagaaacagattctgcccataagtgaaataaaatgctttgtgggggtaatgagtgacttatagtattcaggcagatgttacataactgctaattaagtttccctggattgagtttaagcaaagaattgaaagttgattttggtcaggtgtcagcaaactactgcctataaaccatatcctacccac

SEQ ID NO: 259993 - DNA, 339 bp, Homo sapiens
tcccagagccatctttccaaatgcacatatctatggcacactggcacttaaatctctgatgtttctccctcttctacaggatgaagtccaaactcttttgcatgtaattataaggtgctcatgatctggagcctgcagcctttctaaccctcactcttatttcaccaagtttgtgctccagacatagcaaatcacttcttctttctggagcacactgtgattttatgcttttgtgtatgctgttttctctgtctaggatgtcttacttctatccccactcccctcttacctgttttactccctgtaatcaggatatccatccatccatccatccgtcca

SEQ ID NO: 259994 - DNA, 473 bp, Homo sapiens
gctgggaatgcaaccacacgcccaaacccaaatgacggggatctaaaggacacatggggttctcactatgttgtgtaggctgattttgaactcctgacctcaagcagtcttcctgcctcagcctcccacagtgttaagattacaggcgtgagctaccacaccggctatgagattttattctaacactgtgatttaattaggcttctgaactcatgcatctgctggagtctggcagtgtttggccgcttcatttaaaaacttgatgctaatggccaggtaattgtttcaaagatcaccattgatgaagtgtccagatctatcagccacaaatgctgtgaaggagagaatggctatcttccatttcctttgggtttgctgtacttttagttcagagtagcagtggcccttcaaggtttgaaaaagctgaaaacatcagagaggatgcagtggacaaatattgagtcagtccttat

SEQ ID NO: 259995 - DNA, 184 bp, Homo sapiens
taagaactgtgtagcatagagtagtgcaggcaggactatggtgtaaacttaaaagaggctgagacaatctgggaaggcttcatggtaaagaggcttgcatagggccttggataagtggtactcggataaatagaaaagggagaaaatgaattcctggcaaaagtgtgaaaaaatgttttggaaa

SEQ ID NO: 259996 - DNA, 659 bp, Homo sapiens
gggacaggggtccgatatcctgaatttctatcaagctcccaggtgatgccaatgctgctggtcctcagagtgcattcataatagcaaaggtataataataagaccgaggctatgatgaccagtgctgtgacatttagaattgactcacttgttgcaggcaatatgtgtgcgatagatcctagaagagtgagttcaaaaagcagataaatctgtgcaaaatggtcacttctgtactccaggttgtgatcatcctcaatcagtggtatcaacttcacattttgtttaaaagctggctcctagatgctttttatgtttatagacctgagtttccaccctatccatttattttgctgtggcctcataaagagtagattcctaggaaatcactcagttcaacctcccatccaggacagggaacctccctctctcctgccactgacaatggtccacagcagcctgtcagcctgtttgatatccatagatggcagggacttactatctccaagggagcctcttccattaaggaatggctcttatgaaaacaaagtttgttgctgagtcaaaatcaatttccttgtaacctcacccattaagcctattctgtcatctgcagcatttcaagtccgctctcaagtcagccttccccacactgcagagag

SEQ ID NO: 259997 - DNA, 2183 bp, Homo sapiens
  misc_feature (8)..(8): n is a, c, g, or t
  misc_feature (1856)..(1856): n is a, c, g, or t
  misc_feature (1866)..(1866): n is a, c, g, or t
tggagacngagtcttgctctgtcacccaggctggatctcagctcactgcaacctctgcctcctgggtttaagcgatcctcccacctcagcctccccagtagctgggactacaggcacccaccaccgctcctagctgtaaggttttttttgtatttttagtagagaggggttttaccatgttgaccaggctggtctcgaactcctgacctcaggtgatccacctgcctcggcctcccaaagtggtgggattacaggcgtgagccaccacgcccaggcttccttccaagttcttaaggtgcatgccgagcaaattaatgttctaccttcttttccaatatgactatcaaaagatacacgagttcaattgaaaaaaatatatatatatataaatttccctttgtatatcttcttttattgcaacatacagattttgatatgtagtttttctagaattatttagttctaagcgttttaagattttggttgtaatttctccttgcacctgtgagttgtttagaagtttgttattaagtttccaaacatagaagtttgtataatgttacttttggtgtgtatttttccccttgtgaagaacttacaaggagtggaaatttgatttgactgtatttcactgcatcattaggacttgaaagttctcatggtagggttttattacaggttaatttcagtttaacagtaatgttttcaatacttatttaatatgcttgaagacttcttaagtaaaaattcctaagtaaaatcttaagtaaaaattctaagaggaagtaagaaccccagcaccctattgtgaggttagaagaataagaaagggagtctggactaattttaaacagaaagaggagaatttcactgtggtggggaaatatagtaaagataaaactcccccttttttggtttctttgtaattcaaattgggtgatcatatgcaggaacttagttctcattaatgagtaacatatatagggaaacatgcaaatccatgcaggctccttgatcagaggcatagttagtgaaatacatcagtggttctgctgtctgacttgtttctgcttctctctgtttgcttttataggtagaagaagtgaaaaagcaccaacactgtttagcatttagctcctctggaccccaaagccagacttactacatttgctttgatactttcacagaatacttaaggtggctgcgacaagtctccaaggtaagcaagcacttaatccaggaatccactcagcttctagctggctacaaagttcctttctgctttagctgggtctaaaatatggttagttacacacactttttttttcctccccagatactgccagtgattagcaatttttagttttttaaaaactaattttgcctgaaaagtggctttttaaaaattgttttttacttgcccagtttatacttaaaaataaattggtctgtaaacaggcattactatcttaatgttgtagataaaaaacatgagattgggaatatttgagggactgacccaggctaagacaactataaaaccacaaaatacccagagaattgttacaaatttcccttctttctctgactgttttttcatataaatagtctaatattataccatctccccttcacctttattctgccttttcagtgatttaattttttatcttattttggccattttatattcctctgatttaataagatcaccatgtcccatgaaataatatatagtacttttggccaggcacactggctcactcctgtaatcccagcactttggaaggctgagacaggcagatcacttgagttcaggagtttgagaccagcctggccaaaatggtgaaaccccntctctactanaaatacaaaaaaattagccaggcatgatggtacgcacctgtagtcccagatacttgggaggctgaggcacgaaaattgcgaactgggaaggtggaggttgcaatgagccgagattgcaccattacactacagccttggtgacagagtgagactctgacttaaaaaaaaaatatatatatatgtatatatataatataatatataattatatataatatatattttataatatatatatataatatctagtgcttttgtgtttaatgtaaaccagaatcacattataaataagacaaataaatgctgatatttcaggt

SEQ ID NO: 259998 - DNA, 449 bp, Homo sapiens
acttcccctctccaaaatttttctacgtgttagtaatttatgtcttccagatcgtgtaaatacagatgtgttagacttagtcatctaaatcaattgttcagtgactacagccaaactataaaaaatgattacttctctttgttttcagttcaagtatttttactattcctttgccacacatttatttttcatacagttacatcagcgccctgggtcccttttcttttgtacacatagtgatagagagggaaattactcatctccaacgtcctggaaattgttttccagcgcataaatttcctagccctctgaaagatgtcaatcattttctttagcagggcattagggaactccagctttccgaaagatgttaggaaagaaatgtcatgtccgaagacacaaagtaaatgattactttcttcacccagctttatttgtcatttgtctta

SEQ ID NO: 259999 - DNA, 699 bp, Homo sapiens
ctgggggttaggggttaccccaagacggtgcaggcagtgggacgaggaggccttttacccccatccaccgcagcccttgacttcacgctcgcctcgaagctttcgcaaagtagatacggggactgaccctgttgacacactaacccaaactcgcagacgcgtggggctcgcatgtacccaagacaggaaaacttcacgttggcctggaaacttcttccaggctaagcctgagtcttcaccagacactgcagcacgaaggcccttctgccttttggctcgccctggcccagaatgcgcaccagccggcaagagaaagaggcccactgcaatatgctgtgaagaatacataagaagtcaaactgttgacctcttttccccagcccgttccaaaactacatccctgaggagttgtgcacctctacggaaagttcagatgaaagagctaattccccttgatctctcttcttgttcagagtggaggaaaaacatataccatcccttccatcaatcctcagcataactttgccagggacactggtaacaagctacttttacctcagaagttggagagtatcacttgacccacattgtgtatgtgtaaatatctttattcagtgtatatacaatatattcttaatttgactctcaaagtttataattagcattgaatgagtatgaaacattgttttccaaatactg

SEQ ID NO: 260000 - DNA, 732 bp, Homo sapiens
ctgggggttaggggttaccccaagacggtgcaggcagtgggacgaggaggccttttacccccatccaccgcagcccttgacttcacgctcgcctcgaagctttcgcaaagtagatacggggactgaccctgttgacacactaacccaaactcgcagacgcgtggggctcgcatgtacccaagacaggaaaacttcacgttggcctggaaacttcttccaggctaagcctgagtcttcaccagacactgcagcacgaaggcccttctgccttttggctcgccctggcccagaatgcgcaccagccggtagagaggagcttcgggccgtttagccctggggcaagagaaagaggcccactgcaatatgctgtgaagaatacataagaagtcaaactgttgacctcttttccccagcccgttccaaaactacatccctgaggagttgtgcacctctacggaaagttcagatgaaagagctaattccccttgatctctcttcttgttcagagtggaggaaaaacatataccatcccttccatcaatcctcagcataactttgccagggacactggtaacaagctacttttacctcagaagttggagagtatcacttgacccacattgtgtatgtgtaaatatctttattcagtgtatatacaatatattcttaatttgactctcaaagtttataattagcattgaatgagtatgaaacattgttttccaaatactg

SEQ ID NO: 260001 - DNA, 498 bp, Homo sapiens
ctgggggttaggggttaccccaagacggtgcaggcagtgggacgaggaggccttttacccccatccaccgcagcccttgacttcacgctcgcctcgaagctttcgcaaagtagatacggggactgaccctgttgacacactaacccaaactcgcagacgcgtggggctcgcatgtacccaagacaggaaaacttcacgttggcctggaaacttcttccaggctaagcctgagtcttcaccagacactgcagcacgaaggcccttctgccttttggctcgccctggcccagaatgcgcaccagccggtagagaggagcttcgggccgtttagccctggggtattgaagagaggggtgggggtacagggtgcaccactgtcagagtgagtgggaagctgccttcatgcccagttgaaggatatgggaacagtagcagtgctgtaggtggcatgagggaacattaggttccgttgtactcctcatcccaaataaccgttta

SEQ ID NO: 260002 - DNA, 402 bp, Homo sapiens
ttaggattctgcagttacaaggtcacttaggaaagcagaaatctccataatttagagatattcacttaagaactattcatttataaacctactctcaccgggcgcgatggctcacgtctgtaatcacggcactttgggaggccgaggcgggtggatcacctgaggtcaggagttcgagaccagcctgaccaacatggagaaactccatctctgctaaaaaatataaaattagcccggcatgatggtgcatgcctgtaatcccagctactcgggaggccgggagtctgaggcaggggaatcacttgaacccaggaggcggaggttgtggtgagctgagattgcaccattgcactccagccagggcaacaagagcgaaactccatctcaagaaataataataat

SEQ ID NO: 260003 - DNA, 156 bp, Homo sapiens
cctttcaacatcagattgtagttatgtgtaagttaggatgatctggcagcaagcaatagagaacctaaatgaagcttccctaaatattaaaatttattggctcatataaggagaaagtccaagaaaaaaaaaacatcagcagggttatcttgaaga

SEQ ID NO: 260004 - DNA, 390 bp, Homo sapiens
cagagccagaccctggctgaagaaagcatcagccagaaccttggagaggagaagagaccgaggcaggggctcagggtgccaaagcagccgctcaagctccaagagcttcctcagaagggttgctataaaccaagactgactaccaatataagaaccattctgcttggggaaggccagatcacaggatggggagactggagaagaattgtatgtattaaggacccacatatatcaggtgcttttcatcaatctgtgatgtgtgatgtgtattcatttattcttcccaccttaggagggttggtcttcataatcaggaagatataggttcaaatcctggctgcactatatgccagctgggtgtccttgggtaagttatttaacctttctgac

SEQ ID NO: 260005 - DNA, 394 bp, Homo sapiens
gaaaatgaaaaagaaagtaaatataatttttagaagtggaaataactgattaaaataggctcttagtctgaagacttcctgtcatgtaatcatttaagaggtgtattgctttaggaaagccttgcactaataatctaatatgaaattaggttggaaataatggatgacatcagagagattaacaaagggacatatgttttttgatgtgaccaacctgggcagttagcctagtctagatatgtgccatagacaaattgctgtctgggatgttagctagcctaagactactagatggtttattgtttgcttgctgcagacatgtacataagtgtgtgtttcacttatttttagcacaaaaacaatgcatatgtattacagaaaatttagcaaagct

SEQ ID NO: 260006 - DNA, 319 bp, Homo sapiens
ccttttttacagagatgccctgtccagggaggagcaatctcgcagtctgaacacggcagccttgctgagctgcaatgggctccacccagtttgaacttcccagcagctttgcttacactgtggtggtaaaaccgcctgctcaagcctcagcaacggcggacgcccctccccctaccaagcgccaccgtcccaggtggatctcagattgctgctgtgctggaagcgagaatttcaaaccagtggatcttactttcctgggctccatgggggtgggaaccgccgagccagaccacttggctccctggcttcaggccccctt

SEQ ID NO: 260007 - DNA, 574 bp, Homo sapiens
cagacagatcacttgacctttttgagcttccaggtcttcatctgtcaagtagaaatgatgacctctcaatcttcccgtttgttttaattgtgaacgtttcttttttgggagccttcctttgttgtatcttctcaaaaaaggagccaaatccagtaattttatattttatttagtagtcaagtttcccaaacacttatcagttaatcagtaaaacatgaactggtttaatggcaacatcactgattgagctagtgactcaccttggctcttttgaaaagctaaagaatggtgacttgaggagccaaatgccacacacctaaggagagcccttctctgggcaagtgaattaattacttgcctggcagtgtggaatgtcaccagaatacccaacatacacaaagcctcatttgtaggatattcatgagaatagcactaaaagtggctgattgaggccaggcaccagggctcacgcctgtaatcccaacactttgggaggcgaaggcaggaggatcacttgagtccaggacttcgagaccagcctgggcaacatagtaagaccccgtctcaattactt

SEQ ID NO: 260008 - DNA, 429 bp, Homo sapiens
ttctgttggctggtgagcatttgtttatagtcggccttgactctaccacaattttagaagtagttcttttatttctttaaaagaaacattttgggacaaaatattgtgaacaaataaggaatacgactatatttgtgaaaccccttgttaatttccaagtgacattttaaatcttgaataagacatgaacgctcataaataaagagggaaaagaaataattaaatcaatgttcctaagagcttctcagaaaataagagataagtgatagaactatgatctacaatctaccctaacagtatatttgcatcacttcttaaactttgtttagtattttaacacgctgtttcttattatatgtgaagaatgctgtgaggtagcatgtcaatgttttgcagattaataaactgatgtcaaaagaggttaagtga

SEQ ID NO: 260009 - DNA, 667 bp, Homo sapiens
aattcgcggccgcgtcgatacggctgcgagacgacagaaggggcaggcggtgcgacagggctgggcggaagggaggctcatgccgcacacagggctattttcttggtgggatgaggctttgccaaggaagtcctgcttccagggacaggggtctctaaggcccagagcagagttgaggaaaaaagacctcaaatctgcaggaggacacacagggcgggtggaccccagctccagctggggcgttggtcagggaggggtactggcagcatgagaagtgaagctgccagaagaggaacccacttttactcactctgctgggggccgcccacctgtgctttcccagggagacaggggctgggcagccccagctgggagttgagaccaccttctgggtgaccccagccttgtctcagcccaggcctccggtgcttctggggctcacaacacacatctgtccctggttccttgtcttagcaactcctactccattgcctaacaattttctttctgttcccatctcaggctgaaaaggggaccaccgctccccgggcaacccctatcccatcctgtgcccctctaaccctggaccccacaccttggccctgatgagctcactctcccgtctgtgtcttcacagcccacctcaccccgcctcccccggcccagg

SEQ ID NO: 260010 - DNA, 643 bp, Homo sapiens
tgcaggggcaaaatcactctgattgagaggaccgtgatgcaagcgcatggacagaccgaaggcatgatgacagggagaagagtaagggagctggggaaggcggggcacggagagatgataaaaggatagtgttctgagatgagaagaaacggcctgcagcccgggtaagctccgagatgcattcattcattcagccagtgagtgcctaccatggattgggcactgtgctagtctctcaacaaaacaggcaaggtttttactcagctggaacttgcatttagtaggagagacaaaaataaagtctataataggtgctgataggtactttgaaaagtaaagcagggtaaagggattacagggtgtttggcaggtgttctttttggagtcaacatccaggtctcccatgggcattttggtcaactccagagccaggaaggaccaccagcagtgaccctttggtatcacttgattggggaatctaagagtttgactttgatcttaaccaaagacttttctcttcactgaggtctggacttcaacagaaagaggtcagatctctagccctgtccttgagactctgagactcgaacgttattctaaacgatgccttcaatgttactctcaccttggaatgctttattta

SEQ ID NO: 260011 - DNA, 663 bp, Homo sapiens
ccaattcatatgttgaagccctaatccccagtgtgacagtatttggagatagggacttgagggaggtaattacggttagatgagattgtgagggtggggccccgatcctataggattatcatcctaaataaaagagatgtgagagagctcactgtctgtccaccatgggagggcatggccagaaggcagccgtctgcaagccaggaagagagccctcaccagaccctaaccatgctgggaccctcatctcagacttccagtctccagagctaagagaaaatgtctgtctgtctcttaagccatttagtttgtggtattttgttatggcagcctgagcagactaattcattttacctcagagcattcataaatcaatggaggctacatctttggcccaggactgagactaggaggaggccaggtggatgtctcctaggaggagggacaggtgtatgcctcgtccctcctccacaggcacacagtgcagtcaagggaggatgacagcagaaacttttcttctatcagctccaaactaatgataaaaggggaggataaattctccaaggctgctacctcattaaagggacatcagatcaatatgtcagtgctcctttaactaaggttgggatatggatgccaggtttatctcctgaatgcttcttg

SEQ ID NO: 260012 - DNA, 92 bp, Homo sapiens
agggtatcaacaccattatttttccaatacaaagtgctttcccatcctgcatctcatccctctttttccccctctatggtacatggctgcga

SEQ ID NO: 260013 - DNA, 317 bp, Homo sapiens
actgcaacctttttcttccgggttcaagcgattctcctgcctcagcctcccaagtagctgggactagaggtgcacgccaccaagcccagctaatttttgtattttttcttttagtagagacagagtttcaccatgttggccaggatggtcttgatctcttgaccttgtgatccgcccgcctcagcctcacaaagtggtgggattacaggcgtgagccactgtgcccaccctttatgtccatttttaaaagtaggtgacagtatgatggtgggtgccaagatcagcaggcagcagagaaatactctggtcagaactgc

SEQ ID NO: 260014 - DNA, 119 bp, Homo sapiens
tctcagataatacagattgtacttactagaatttcatgttataaaacattataaacctcctacatgatttgattggtcaactctccttcacagcataataaattctctttgtaaaattt

SEQ ID NO: 260015 - DNA, 327 bp, Homo sapiens
caatggaggagaaagaactcaatcacactgaaacagccaggagaacccatgcttctttctccgtataataaccattataatgtaagaaaagttacactggacaagttaggcaaggaagactttattcaagacaattgcaaaagagatcaagactatcacaatggaggagaaattgaactcaatcacactgaaacagacaggagaattttaagcattgaggtgagttagtaagtactgaaagacactagaggtgagatcggtaaatgggatcaggctatctgtgtttgctaattggcacctactgaagttaggcttctcctttcccac

SEQ ID NO: 260016 - DNA, 399 bp, Homo sapiens
acactcaaaatagataaagcaattagaaccaaaacacaaatgcagatatgacatatatggtggaactgtcccataagtattcttaaataactatgatgaatatgttgaaggctttagtggaaaagctgggcaacattcaacatcagatggttaatttcagcagagatacaaaaattttatttgaattaaaaggaagtcctagaaatgtaaaacatagtaacagaaatggagaatggctatgtcagggtcatcagtagaactggcaggcagtgagctgaaagataggtcaatagaaatcacccagactgaaacacaaagagaaataataatgaaccattcagaacagaacacccaagaaccatgagaaatatcaaatggtacatgtaattggagtcttgg

SEQ ID NO: 260017 - DNA, 677 bp, Homo sapiens
cacatatacagcattggtcccatatgatagggaactggaaaattcccatcacctagtgacaccttgatgatcctgaccccatctaggcctagattaatgtttgtgtgtcttagtttttgacaaaaatgttttttttttgtttttttgttttttttttttgagacggagtttcactctgtcacccaggctggagtgcagtggcacgatcttggctcactgcaacctccaccttccgggttcaaatgattctccttcctcagcctcctgagtagctgggactacaggcgcctgccactgcgcccggctaattttttgtatttttagtagagacgggttttggccatgttcgtcaggttggtttcaaactcctgacctcaggtgatccgctcacctcggcctcccaaagtgccgggattacaggcgtgagccaccgcgccgggccgggtatatagatttgaaagctcagtgttggcacagtgaggtgggctctgagtaagggcctgtgttagtttgcaagggttgccataacaactggcaaccgacagaaccataacaactggcacccacagattgggtgggttaaccaacagaaatttatttatttttattttgagatggcgtctcactctgtcacccaggctggaatgcattggcgcaatctcggctcactgcaacct

SEQ ID NO: 260018 - DNA, 493 bp, Homo sapiens
cagagaggagagcaggattttagatgcagacctgcctgcccaccatgtccatgttctatgaccacacttttctctttcctgttcacgccacaaaagatctcaccggctgtgggaccagcagaaggaacacaaaccttcaggtactccccaaggttcaaattctcaagctagcagcgacagcactcagaggccagggaccatgatctgttcatcttatgccccagcacctgtcttaggactcggcatataggagtcactcaacagtttgctgaattaaatgaaattgaacttggctttgctgcatttaacaaaaatgtaatcatcaattataatgtatacctttgttttttattcctaagaagaaagcactactgattataactgtaagatatataccaatcaatgatgtacatcatcagttttaagagatgttaaatctgatttcaattttagagatgttaaaatatgaaaatgtctgattaatgatataact

SEQ ID NO: 260019 - DNA, 301 bp, Homo sapiens
agcattcagagagagtgcctgaaggagcagaggggacagaagagtctgttggcctggactttgagaaggcttcctgaagcagcaggaagaacttgagaaagacctttaagcatgctgggatttgtattcgtggatgaaagtatgagggcatcctaggtagaagatacagcatgagcaaaggaccaggagcagacatgaatgagaagaagggagtcttcactctgggaatgggaggatcttcaatgagcagggactaatttttccagctgactctgaataaagatctacaaaagctgtcagc

SEQ ID NO: 260020 - DNA, 460 bp, Homo sapiens
cggccctgggctaaccaatggctgtctctgttgccatccctatgaggtctcactggactaagtccactgaccttgcttctagcccctccttccactttacctctcaccagctacgtactttaggaaagccctttgacttctttgggcatcagtttccccatctttacaaatgagatgtggaccaggtgagccttaaggtttctcctagaactagtgttcaggttccttgtgagggccagtggctggcacgctcatcacaggccaggccacacctggatcgtaggaactaccccattccacctctctggaacattcctccaaagagaggaactcaaaacatccttttagggcaagggttgcaaacaaggttgaggaccacacacagttttcccatgagttttatttggcctgcagttttctagaaatgtgaatttgcggcaaaatcaagtttccaacctct

SEQ ID NO: 260021 - DNA, 516 bp, Homo sapiens
ttcagacctgtagatgggctcttcttgaacattctggagtccctgggggaaagggaagtctgcagctcagttggccacctctgcataacaaataccgagagcactgcaagtggagcttggacaaggtctggaaaatcagccttcttctggatgcctccagcctttgctatcatctgcctaggaggttggaagttactcaagcggctcaaggaaaagtccctatttctgttgcagttgatttggagttatgtgatgtgtagcccatcagaagtaagcagaaaactttgtgccgttttctgtcctggaaataacacccccgccccctggccccgctgcattatcagccactcctcttcactcctttctatggctccagaagtgaagagctctgaaatgcctaaattgccagatgtgaacatctttactgcttggagaaagccacacaggagttacctgacctgccttggatggtgacatgagtgagaaataaacctttgttgggttagactgctaaga

SEQ ID NO: 260022 - DNA, 655 bp, Homo sapiens
aagacaccaagcttggttctcaagggttagctataacaggataaagggtcactgttcatctcattccattctgcttctgtcacccaacacatgcccaaaacagatgcaatgttctaatgtaaaaacacctagaagaggcatgtgaataaacaatgctcacaccaggcacttcgccagctgaccgtgaagaattcttccttcaccatgagctccagctgctgcccaggacccctggtgaggggagggcaggaggagaggagggaagacagagggagggagccagaaaggaaagggaaagcctgtgcacacgagctaagcttctgagcacatgtcatgtactgaaagagaaagcccaagtcgccccggtgatcatggtgctttgtctccggagggaaccaggggaaaagcctttggcagcaatcagcattctatacaaagcagattgaactctccccacttttgtggaataaagttttataaaatattatttacactgaatgatttaacatttgtagagattcatccttttttggtttttctgtacatgtaagacattcaaaatttgcactaacagaaaacagttgctgcttctaaaaccaaatctgatactaaagaagacaagaagtaagatgagcttgtaaactagcttaaatgt

SEQ ID NO: 260023 - DNA, 430 bp, Homo sapiens
tgctcaatatttctttttgctcatagccaacaaaccagttatattatcattttgtgaagtattgctatcaaaaggtatgtttctcttgcactttccctgcctagactggacactgtgaagttgctgtggctgcatttctcaggtctggctgttccgctctcacttggtccagggagtgggggggattttccaaataaacagcacaatggattcaacagcagcagtaaatgttaggaggaatatgtaggtgacagaagctctcgtcgcacctgacttctcaatgaaaccagtgatgaacccttccagtacaaaaactaagtgaactacacctccagctgttgagccctcctagttctcaccccactccagctcttcccctctctcagttgtcccaattgtaactcaaaagatggaatatcaaagtcttaaa

SEQ ID NO: 260024 - DNA, 226 bp, Homo sapiens
agatggctacattcttccagcatggtctggtttctgtcccattctgttccttatgggttttcagctcctctgaagtagagaaagcacaggccgcctcaggattcctctgtggatgttgatcatgttgatgatgacgatattgatgaccaacatgtattttccaaatactcgtgccttccgtaactcagctaagtctccagagaccctggttcctccaggagtgatc

SEQ ID NO: 260025 - DNA, 381 bp, Homo sapiens
gtgactcaattatcctaattgaacaacaagtattagccattgttaaacactgcttagaacattaatgctgattaaaactttaccttgaccatatccagttaaatcctacccaagttttggatttcttctggccacatgtacctcagtctagattctatcttcttgttacacagtgcttttataccactctgtacctttctagaagaaatagtattactgctagtaattatatatttctgagtttattagtttaatatttatattctcattggattctaagttctgtaaggaaaagaatatattttgctcagaattttatttgtgctgcttggcagtggctggcacatagtagtcctcaataaacatttgttggatcaacaa

SEQ ID NO: 260026 - DNA, 408 bp, Homo sapiens
cttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccac

SEQ ID NO: 260027 - DNA, 469 bp, Homo sapiens
atttattgatttctggcttttatcacattgatctagctcaaatttagttgattttgagtgctttgtcagaaacagaacttccaattattccattgttctaatgggaaacatatgttctcctttacgatcatggtttatgatgggaggttataggattgtatttcagggactgtcttttaagaattgtactgcactaaaaaaaaaaaaaaaagaattgtactgcactagtctccagaacaaagatgaattaatatctatggtaatgtcttggtcatttgccatctgtggctcaatacttactttgctaatacttaatatgataaatgctattaatatataattcattctgccatgttagctttatataaaatgagctgttttgaaatattaaatttgagaataattgcataatatagcaattcaattttcccatcacaaataaaatattattgaatattaaatacctaaa

SEQ ID NO: 260028 - DNA, 428 bp, Homo sapiens
ggtctgcacagtggctcctgaggccgagttgatcaaaatgtaatcagttctaacgcaagacctatttgatgacaggtatggtgtggccgtgtgtaactatccttacaattaattaacttttcatgtcgttcattaagctccataacttatgaggccgggcactgtacagttggaagtcacagaagggaagactggagttaaaccgtgctagggtgtccctggcatgaggggcaccctgcgtggcagctcccagagctggtgtctgtgcacaagcatggtggggcttacccgacccctgcccctggctcagctggggactcatggtggagcagctgcagtcgctgtaggatcattccctttgtgactggaaataattgtatttgtgatttgcacaatgctgcaacatattgatttttcaattacgccgg

SEQ ID NO: 260029 - DNA, 402 bp, Homo sapiens
tgctgcaaccatcacaaaaggaaatgccagtagaaaactaatttggtatttgttgttttgtttgtttgcttgggtttttggttttgttttttgtttgtatatatgtttccttatgtttcttacctaataagctgaaatggagccttctccttttctttcacttaaagatctctcttagctgtaatggtttgctctccaggcattgtctatatctaaacagaacaattgaattgatttgcttttctatgctttgggggttttgtctgattaccccatttaaatggaactgtttgatcacaaattggaagttttgaagcctgcaaactgggagatcttctgctatctctaaatagcaagccactgatttccaatttaatatggttacttcatttacacagggtt

SEQ ID NO: 260030 - DNA, 874 bp, Homo sapiens
gagacacacgggtcaggggggtgatagcacagtctaggttttagtgaccttggggccaagagtgaagccacactctcctcccacggggcaggggaccactggctcggtaagatctttaaaatgcagtgatatcatacctgtctaggagaactttctctcactgccattctaggagggaggctcacatacattgtctccaggaggccctccccgctgtcttttaaaatgtccacgttttacaggaggggacagcagcagatggaactaacaaacacagtaggatggcttgacgtctcatttgcttgatgacacttgccaagccagagaactgtgagcagacaaatgtaatgaatgactaaggagatgcagggcttcatatgttgagaaaatattttcgtgcattatgtcattgaattctcccaacagccttgtgacgtaagtacagtttggattcccattttacagatgagaaagctgaaaactcaagtaggaactcaagatcccacagccagtaagtggcagaactgagattcaatttcaggtcttcaggagaagggcggggggtggtggtggagggaagtgtccaggtcctcttctctgttggacagtagattcaagcacattagaagaggtcttatggagaagcataaaatgaaataatttttctgtgttggctgtaactcctcctccatgacagctatacttcagttgtgtcaccaacgaaaacagaggctgtatctcattcatctttgtcttcccaaggcctcctgtgtgcctggcacagaacaggcactagtgtgtgtgtttgctgaatgaaagggtatttgagagtttctgtgctgtacgctgctatatggaaatacatgccagatat

SEQ ID NO: 260031 - DNA, 472 bp, Homo sapiens
ctgtggcagagacggagaagatgaacagggattttataccaggcgtcagaagggaaccagtgctaaagaaaatgaaaacaccaggccgggagaggcagctggcatgcgggccgtggtggttttacgtggccgatttgagagagtgagacccctggggtcttggagccaggcctgggaaaagctacttcacgtcaggccaggggctgtagccctggcaacctccactccgcctggaaatcctccacctcggggcctctctttgcccagacctggcccaggaggagcacatgggagccgggaccttcccaacaatccttgccgttggctccacaaacctcagccagtcctgcaacctgggatgccttttccaccaggatgcctgctactgtcactgttgtcattagataattaatgaactataattagaaatcatatcaataaaatttcacagtctaaggctgttgaaatagga

SEQ ID NO: 260032 - DNA, 650 bp, Homo sapiens
ctgctgaggcgcgatggctgcgaggccgctaggggcgcttgcaggcggcacagactggtggagccgagtgacgcggccgccagaggtttgggccgattttggagaccggtgattaggtttctttctgcctgattcagtcctgctaagttaaaacgtgcaataatcccttactgccaaggcacacgtttctctgtgtttcaggggtatcaaaagcatttgctaaacaagtcaaacccgtcgttctttcggtctattctatcagtgcctggagaggaatctggaagaaggaggtggagaaggaaggaagggcgtggagggtgaagacggccctgtgttcccctgggctggcccggccctcctttcccagagcttttccccctctcgccgtcactcccgggggccctgggccaggagggaagggggatggaggggagaacggcagccagaaaaagttgatcatgagatttgcttgaatcataagtgttcaaccattctgaatgctatatggccagcactatggcctgtgccaagggattatatgatgatttacatgaggggttttgggggtggaacttattggcctaatgggggagaggtctggtctatgcatttatgcttataattgataacttggtacacactagggaagg

SEQ ID NO: 260033 - DNA, 308 bp, Homo sapiens
gtgggaggtgactggatcactggggatggtttctaatggtttagcaccatccccctcctggccgttcttgtgatagagttctcagtagatatgcttatttaaaagtgtgtggcctggccaacgtggtgaaaccccatttctactaaaaatacaaaattggcctttttgcagtggcacatgcctgtaatcccagctactcgggaggcttaggcaggaggatcacttgaacctgggaggcggaggttgtggtgagccgagatcacatcactgtgctctggtctgggcaacagagtgagactctgtctcga

SEQ ID NO: 260034 - DNA, 350 bp, Homo sapiens
ttgtgcatgaggacagatttcaaagagtgcatgcccccaaaatgcaaatgcctgttgcaaatcaatgggaaaaagagtttaatactgtagatggcattttaatttaccttcagtttttcaggatgacacctgtgtatctctcctgtatctctccttggatatggtcagaaaaacctaaaagctcagataatcctaagccaatccatgcttaggcttttaaatttgcagatttaccttcctatcaacttatttgaagctaacattaagatgagtttgccttccctgagcaaatgagcacaggtgttagtccagaaattgcaggaaaccagaatgtaaccagccacaccggg

SEQ ID NO: 260035 - DNA, 644 bp, Homo sapiens
aaacatttgtcaaaatatcaaactacaatatgaaagtgtgagttttactgtacaaaaattatgcctaaatagaccaaatttttaaaaaacctaatttaagatttttaatctttaagaatcctaggagagaacatattttttaagttttaatttcattcatatcactaataactacaacttattacatgtttcctgtggtgggtcttttacccatattggctcatttcgtcttcatatttaagtatagttccatttttatagatgaagagaacctaactctgaaaattttattatccatgtcaccctgagatgataaacatggactttcaaaatctaaagcccttcctttcccactatgttttgctgcatctcaagtatttatttaatgcaaacatgttaactgtatttacattaattcatgcagtccttggaaccaaagtgtaaggtgtatgccgttatatccattttcagatatggaaacagagggtaaattatttgcctgggtcacatggctcttacaaatggaggccaatcctgctgtaattcaaaagactatgctctctctactctcattgccccctataatgatctggtcttgaattgtctgtgtgtgtattctaataaaattgtattttgtgacactg

SEQ ID NO: 260036 - DNA, 621 bp, Homo sapiens
gacatggtggcgtgctcctgtagtcccaactactcggaaggctgaggcaggagaatcgcttgaatctgggaggcggaggttgcagtgagccaagatcgcgccactgcactgtagcctggctacataacgagactctgtctcaaaaaaaaatgggaagaacaaatagatatgagacatattttggaggtaggattatgactgattggccaaggccggtgaggaaaaaggaggcattaaggatgactccaaaacaagtaagaatgtctcaggggccccgaagcttggctactttgcccgaaatagattcttctggtcctgggatgctccatggatcatggcttagcacagatttcacagccagacagtcctaaccaggcctgttgagctggtcatgggagatagtagttccttattgctttctcgtatattctgttgatgattcttaaggcatcacagagtagaggtcaatgataaagacgatggtagtacctactaggtctccaaagcagacatgacaccaaaatagggtattcactttgaagttcctacttaaatttatgtgtactcactctaatttttttgagtagaaaagagtaaattcatgtagtttaatttttcttt

SEQ ID NO: 260037 - DNA, 327 bp, Homo sapiens
cctttctcgaggtttaccggcctatggtagggatacttttctcagtagcttctttctctgcctgtatcaggcccagcctcaagagagccagtaacatcttgtgtggtcatattttcccaagccagccatccttctatagccctgagagggaagggagggtctttctggctcagaggcttgacataccatcagtttggaaagagccaggttctcccttctcagctccgcatgccaagtccccttgctgcccatggcctctccctcccctgtctgctgtgtgatggggagtcatgtaccacttcaccaggctgctggcactggcatgga

SEQ ID NO: 260038 - DNA, 750 bp, Homo sapiens
ggtaatacttcaaggaagattcttcaactttaccatccactccctctactaagtttacctgttttatattgaattgctaagtttttttattgttctttatctctatagcatcctttcttgactcactaatgcagtaccttttcttactactctaaggatattaagcaaattcacttaatttgggggttttcctgaaaatttttttgttccctgcatcctggtctgttcttttcctcctttgtgtgtttggcctctgtcatcttggagcctttctcagatgtgtggtgatcctcagctaccctttcatattttagagggaggcactaaacatggtgactacaatttgagcaaaggccaggaagagagatgtcacaaagtgtgaacaggaagccacacagggcggctgaagtgttggtaccagacagtggttcctcaggcaggggcaagcagctctgatttgaacccagtctcttgcctttgaggccagtgccttgaccaccatgtcagtgttaggaggaaacattgcttaatgttgaccagtcagacttctctaatttggtgtctgcaggtggagttttgtttttgattaagggactagtaaggctggaaaagaaagttgaaaattaatctgagacatacaccagggaagaacggctaacctctagtgtctacacagctcaaacaaaggaacccatcattatggtattcttttactgagagcgaaataaaatgtcaaattagctgagcaaa

SEQ ID NO: 260039 - DNA, 403 bp, Homo sapiens
catgaatgcatgataaaactgagtagttaaagttcattgaggaacaggacatttacaaaactggaaagcatctcctcaaaattgcttcagagagtagagatctattggatacttcctcaacttagtgattaaagttaatatccccagtactgtgacaagtcaacattatatgtttcttacatgatgcactgagaagagcccaacatcacttatttggtattcttgccaaaaatgcattaactaaatataataatgaagaaacatcatataaacccagattgatagaaattctacaaaacagttgccctgcaatcttaaacattgacaaggtcaagaaagaaaaggtaagactgaagacctgtattcccagtcttttagtagactgaaacacgacaactaaatg

SEQ ID NO: 260040 - DNA, 253 bp, Homo sapiens
acgttctcagatcactcactctggatgaagttagctgccatgtcgtgaggacactcaaatagcctacagagggcccaagtggcaagggcccgtgagacgccatcttgatgtcagctccagtcaagcttttgggtctctcagatgatgcagcccatcatctgcacctgggccaaaacctcccactaagctccccacaaattcctgacccattgaaaccacaagatagtcaatatttgttgtttaaagccaccaa

SEQ ID NO: 260041 - DNA, 427 bp, Homo sapiens
cagtcatttaaactttcacatagatattatactttaaccattttaaacatcattgcataccacttttctccccctcccccacccttgttttctattgatctatggaatacaaaacaaaaaataagatttcaagaaggacaagttactgaattaagaacattttatttgtctcctcttgtactgtagattttaaaatcgtctattttcctgatgcctcaacatcaccacaagcaagctgtaagcagcgggcccaggagaccaggtgcaccagtgggacaaggctggtcaccatcacagccttcccatcctgtcctcccctggttgtgacctagtgacactcaaacacaccagtaaaatcccttcaagccttttgcttgtgtgctccaccctgccccccattaaatacccttatgcactggtccatact

SEQ ID NO: 260042 - DNA, 573 bp, Homo sapiens
acttgagtattgggcatgttgtcccaatctcacagctaatacgcagcagggatttggtcaaatctgtgtgacaacaccacttcaccaccaattttagtatgaaaacctttaaaatacacagaaagttgaattctacagtaaactctcctacacccaccatctggatcctgtcattgaactatattatatttattacatatccatccatcactctatccatccatcaattcgccttgtttccaagtgaatacccaaagactacccaaaccagaaaaccagcaaaggccttctgcattcgcctggattaagttctgggagtagaggtgctattctacctcggtgatgcgaagaaaagccgcagcactgagcctgattgatgtgctttgcttaaagtttgcaaaattccataaacctgaaaattactgtcgattatgcaagatgacaattgcgtccaagcaggagtttcaaaaatcataaaagctagggggaagtccccatttctagactaaaattccgaagtcgagttccatgttttatattctaaataaaattgtggctatccaaggttatcgg

SEQ ID NO: 260043 - DNA, 1167 bp, Homo sapiens
ttttatcatttttcagagaagcaaaccgggatttagagaggttaagtaaattcctaaggtcatgataaccaaccagacctcaaatgaatctccagtaattcctaaagttatatttcataaggagttcaattttcttaaatgtgtagataattacaaataattctgtttctcaaatttctggacagaaatattacctgggtaatagttattttttttaacataactattgagggtctttcatactaaaatataaatatttaacatgatttgatatgtaagttcaagtattttatactctctgcagccttaaacctattggcttattttattagagggttggtgggattgagggatatgggagcaaagggagagagaggaaagaacgttgtcctcagaatggaagggaaacactttcctgtgctacccagagtagagatcagacaatgttaaattttgaagccatgtctgttcctgtcctgaggatccctaactaaattgtgttagaaaatcttgcagtttgcttttaatgggagatgtttctggcaggacatcaatagcttttgatagcgtcaagaagaaaataaagttacatgcagaagcataaaggggtaggatgaaagttgaggaatatagggacaaaagatgagggaaaggaatatcctaatacttggaagtttgagcatggaaagtagtctaaagacgacttgggaagttccaagaaaatgaaccaagaaaagaacctctgcaagaactatgagaattcccaacaattgggttggattgattcatattagtctattacttgggttaccttgagtgtggggattcttcttgcagttttaacacttgtactatggtctgaatgtgccccccaaaaattcacatgttggcatttaacccccaaagtgatgatctcaggagatgggacctttgggaggtgatcaggtcataaagatgaaaccctcgtgaatgggattagtgcctttataaaggagaccccaaaataattcccttaccccttttgccatgtaaggttatagggaaaagtcatctatgaacaaggaaatgaaccctcaccagataccaaatttgtgaatgcctggatcttggacttcccagcttctagaactataagaaataaatttctgttgttcataagcacccaaa

SEQ ID NO: 260044 - DNA, 167 bp, Homo sapiens
tcaagcttctaacgatgtacggggacatgtaaggttatagggaaaagtcatctatgaacaaggaaatgaaccctcaccagataccaaatttgtgaatgcctggatcttggacttcccagcttctagaactataagaaataaatttctgttgttcataagcacccaaa

SEQ ID NO: 260045 - DNA, 678 bp, Homo sapiens
agcttttccaaaatacactgcccctccttcctcaggaatctctggcacaggtatgagatcctggcaggtatgagagaaaggaaaataagagaatctgcctggtaaccatcagaggcaaggaattaacatattatctaaaactatgttaaaaggtcagagcccaccacagtggtgcatgcttgtaatcctagcgctttggaggctgaagcagaaggatcacttgagcccaggagatcaaggctgcagtgagccatgaccacaccactgtactccagcctgggcacatcaggcatcagtattattctagcaccccagttgacttcaatgagcagcaagggctgagaaccgctgcttcacagaagggagcatgtcctgggggatccaggaaggtctttccaggcctgatcttgttggttactttcatttcccgacaaagggctgctagatcctcctgtggctctcttggatcatccttgcgttttgcaaaatattgctttctttaaacattcaaatatgtggctcctctgaaactgtgaacatttctgaagatcatcatgaactgttggtaactgtaaaatccaaggaggcagagtcagaggaacaggtatctggagacatgggtggctgctgctcccagcatcaaaagcgttcatctgaagtcatcccgtgggtggaagc

SEQ ID NO: 260046 - DNA, 349 bp, Homo sapiens
aagtataaatcagaacgaaagaaattgcttccctagaacaaatccattgactgagatatgcagtgaaaggaatccaagctggctgggaagaaaatcacttggcccccgagataaatgtggtcaaggaatcctgactgacaacgtcagcaaaagcagaaagatttcgttgcagtttcggtaaaaactgccctcatcaaatgaactgaaaaataatcctttctccagcattttcaggaagagtttgtgaaggtttgatatatcttctgcaaatatctgacagaattcaccaacaaagattgtattgtattcaagcatctaatctggagattaaaatataataacctgcaaa

SEQ ID NO: 260047 - DNA, 321 bp, Homo sapiens
ccccaaaatgcatatgttgaacccctaacccccaatgtagctgtatttggatatggatatggtggctctaagaaagtaattaaggttgaatgaggtgttaaagatggagccctgatcccataaattagtatcttcataagaagagacaccagagagctcactcactctgaggaacacagaggaaaggccaggtgagcacacagtgagaaggcagctgtctgccacctacgaggagagccctcaccagacaccagctctgctataccttggtcttgaacttccagtctctggaactgtaagaaaataaatgttcgttgttta

SEQ ID NO: 260048 - DNA, 1104 bp, Homo sapiens
ccagagagagagttgggtcctgagagaaaggaaggttgtggtaattgacacccctgaccttttctcctcaatagcttgtgctgaagacaagcaacgcaacatccaacactgcttggagctctctgctcccagcctccatgctctgctcttggtaattgccatcggccatttcacaagggaggatgaggaaacagccaagggcatccaacaagtgtttggagctgaagccaggaggcacatcattattgtcttcactcggaaggatgatttgggggatgacttgctgcaagatttcattgaaaaaaacaaacctctcaagcagttggttcaagactatgagggccgatactgcattttcaacaacaagaccaatagtaaggatgagcagatcacccaggtgttggagctccttcgcaaggttgagtctttggtgaatacgaacggaggaccctatcatgtgaacttcaaaactgaaggcagcaggtttcaagattgtgtgaatgaagctgcatctcaagagggagacaagccacagggcccaagggaaaggcagctgcagtccacaggacccgagcagaatccggggacatcagaactgacagtcctccttgtggggaaacgcggtgctggaaaaagtgcagcaggaaacagcattctggggaggcaggcctttcagaccggatttagtgagcagtcagtaacccagagcttcttgtctgagagcagaagctggagaaaaaagaaagtttcgatcattgatgctccggacatctcatctttaaagaacattgactcagaagttagaaaacacatctgtacaggcccccatgccttcctgctggtgacaccactgggcttttacactaagaatgatgaggcagtgctgagcaccatccaaaacaattttggagaaaaattctttgagtacatgatcatacttcttaccaggaaagaagatttaggggatcaggatctagatacgttcttaagaaacagcaataaagctctctatggtctcatccagaagtgtaaaaacagatatagtgccttcaactaccgggcaacaggagaagaagagcaaaggcaggcggacgagctcctgga

SEQ ID NO: 260049 - DNA, 1675 bp, Homo sapiens
gttcttgcagcccttctgaagctcagcctggcaccggccccggcgccccagcccctggccaagcctctgctgtcatttctcctccctcctctcagtctgcagctgcgggacgggccgggctcctcagtttctgctgtgttgtgaccccacgaggcgctcagcacccagggaaggcgcgtgtgtccccgatgctggctcctccctgagccccgacggctctcgaggttctgagcctgtggcctgcacagggaacttcctctccgactgcatttatgcctctgtggatgtgaaggctatttctagaaatctcttcctttgcagaaacacccgaaaccctcctgccaggaagaccagggcctgggaagagggtcgctctccggccattctcccctcaccctcctcaccttcctcacatcctgtgccctgggggaccagcagctgcttccacccagaacaagcgggagcctgtgtcaggaaagcatgtcagagcagagctgccagatgtccgaactgcggctcctcctcctgggaaaatgccgctcgggaaaaagtgccacaggaaatgccattctgggcaaacatgtgttcaagtccaagttcagtgatcagacagtgatcaaacccctgaccttttctcctcaatagcttgtgctgaagacaagcaacgcaacatccaacactgcttggagctctctgctcccagcctccatgctctgctcttggtaattgccatcggccatttcacaagggaggatgaggaaacagccaagggcatccaacaagtgtttggagctgaagccaggaggcacatcattattgtcttcactcggaaggatgatttgggggatgacttgctgcaagatttcattgaaaaaaacaaacctctcaagcagttggttcaagactatgagggccgatactgcattttcaacaacaagaccaatagtaaggatgagcagatcacccaggtgttggagctccttcgcaaggttgagtctttggtgaatacgaacggaggaccctatcatgtgaacttcaaaactgaaggcagcaggtttcaagattgtgtgaatgaagctgcatctcaagagggagacaagccacagggcccaagggaaaggcagctgcagtccacaggacccgagcagaatccggggacatcagaactgacagtcctccttgtggggaaacgcggtgctggaaaaagtgcagcaggaaacagcattctggggaggcaggcctttcagaccggatttagtgagcagtcagtaacccagagcttcttgtctgagagcagaagctggagaaaaaagaaagtttcgatcattgatgctccggacatctcatctttaaagaacattgactcagaagttagaaaacacatctgtacaggcccccatgccttcctgctggtgacaccactgggcttttacactaagaatgatgaggcagtgctgagcaccatccaaaacaattttggagaaaaattctttgagtacatgatcatacttcttaccaggaaagaagatttaggggatcaggatctagatacgttcttaagaaacagcaataaagctctctatggtctcatccagaagtgtaaaaacagatatagtgccttcaactaccgggcaacaggagaagaagagcaaaggcaggcggacgagctcctgga

SEQ ID NO: 260050 - DNA, 539 bp, Homo sapiens
ggcgggcccggcccgggaaggcaggagttggtttttaaaggcaactggttttaaagccctttgtcgaagttatacggcccgcaagggacattctattttacttcacattcacctggtgaacacaccatttgcttagaatctaattctacaaggcttgtgtaatttggagggagtaggctgcggatccacttagatattcgagttggagaacacgaccttgatgcggccattgctcaagcaaaggacaaagttaatgaacttaccttcaagcttgaacatctaattgaacaaattgagcaaatagtcaaagaacaaaactatcaaagggaccgtgaagaaaattttcgaacgaccagtgaagatacaaatagcaatgttttatggtgggcttttgcacaaatattaatctttatctcagtcggaattttccaaatgaagtacctgaaagacttctttatagctaagaagattgtttaaaatattatcaataaggacaaataatctgcataatgtttgagttaataaatcaaaatacctgc

SEQ ID NO: 260051 - DNA, 531 bp, Homo sapiens
ggctcgactcctggtttgggaatgtttgtgatattccaacttacaatgatgagtgtcgaagttatacggcccgcaagggacattctattttacttcacattcacctggtgaacacaccatttgcttagaatctaattctacaaggcttgtgtaatttggagggagtaggctgcggatccacttagatattcgagttggagaacacgaccttgatgcggccattgctcaagcaaaggacaaagttaatgaacttaccttcaagcttgaacatctaattgaacaaattgagcaaatagtcaaagaacaaaactatcaaagggaccgtgaagaaaattttcgaacgaccagtgaagatacaaatagcaatgttttatggtgggcttttgcacaaatattaatctttatctcagtcggaattttccaaatgaagtacctgaaagacttctttatagctaagaagattgtttaaaatattatcaataaggacaaataatctgcataatgtttgagttaataaatcaaaatacctgc

SEQ ID NO: 260052 - DNA, 461 bp, Homo sapiens
tcaacctcccaaagtgcttggattgattacaggcgtgagccactgcgtctggcccattatttcagtttttatagttaatttatgtcttgtgtttctttagttttagcacccattgaagtttagtcttgcccagttttaaaatttgagcttttttccccccacttttttaaatctaccatgttggtttctgaattttgatgtgtcttttaattgacaatggaattttaatttttttacacaaaattgtactctgctttaaacagacctcaattataaaaattaatattcaaagtatatacaaatgttcagaaatacagattttctttaaaaattatattctagggccagatgctatggctcacacttgtaatcccagcactttgggaggctgaggtgggaggattgcttgaggctgggaattttagaccatcttgggcaaaatagcaagcccccatctctgc

SEQ ID NO: 260053 - DNA, 333 bp, Homo sapiens
tgctcccattgttatgataggctggagtttacggagacagttttaaggctgggagtttcccagacgcggcgccacaccatcctctcctcacctaggtttcccttcactgctcattgtgcccacacccagttttgcagaggattttctgtgaatgtgtagtgcacagacacgcatactctctttcctaagctcgggaacttaacccccagtaagcttaagctttcaggaaggaagaaagaaagaaaagtaggtattcacaaaagggttggggactccagacgtcagcattaaaggtaggtctaaaaagggattagcagaatagcctggacgaca

SEQ ID NO: 260054 - DNA, 1042 bp, Homo sapiens
tcgtgccattgcactccagcctgggcaacaagaccgaaactgcatctcaccaaaaaaaaaaaaaaaaaaattactaggaatatggcagagtaaaaatagactcaccaaaataacaaacatctgaatttttaaaaaatattcaagtagacaaacttcaattacggtaaacaaagatagcacctcaggctggattttagaactgtggaacagcagcaaagagaaaagctgtgcacaaacccagagaaaacaatggtagcagaagaaacagaaaaaatccaaaatgtgaagaaattggaattgtcagtaacagggctggaaaggataaaaaacacaaaggctattaaaaggaactgatcagggaaaaaaaataagtagattaaatgtgaggcatggtgccacacatctataagcccagctactctggaggctgaagcaggaggattgctggtgctcaggagttcaagtccagccaaggcaacatagtgagaccctttctcaaacaaatatatacatctggttagaattagatgaaaaaaagctaaaacattgcgatgaaacatattttaaaattacaacatcctttgatgaaaaaatggaatcgaaataatgaggtagtcagtaaaattaaggctaaatggaaagatcccgattaaaacatagatggaatagacaaattgattatggcaattccaataaccctaggtggttgttgttgtggttgttgttgttcccccgcccaactgccctttaaataatgggaaggagtgtaaatcggaggaagcctcagaaaaggaaacattaaagaagttactgtagaaaaatagacttttgcctacagactgagaggtttcggagttacttatttccagatttggtacttaaagacaaaatacccaaatacctacttgtcagtttcttaaaactggaaagaagtcttctggtgtatactgagatttgaaagaaaaaaaaaaagcttgaaagaaagaagagttatcctctgaagaataaaaaataaggataacctcaaactttaaactcaaac

SEQ ID NO: 260055 - DNA, 463 bp, Homo sapiens
ggcttttcaattaaaaagtagggcacagaaacatgagcacatttagggaaaggcaaattcatacaatatgtggacaaaattagatggaaatattatgttgagtcacatgaaattgtaatatttgattactattttttaccaaaaacactggcagttccatgtggattcacctaatatactcagtgaacaagcatttgtggagtgcctgttttgcaggtacaatccaagtacgaagaattagaaatgagacacagtctctaccctcaggctccttgtctatgtagagatggacatggaaagccagtgagaggtcgaataggaattataaccaaagtcttctgagtcttgtccctctcctgtgcattagctatggcatttgctcttaattactgggaatgtggcctctagatgtcacaatcacttagtagtccttgaataaataaaatatttaatatttgatata

SEQ ID NO: 260056 - DNA, 613 bp, Homo sapiens
caggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctgttctttacaaagaattgaacctg

SEQ ID NO: 260057 - DNA, 449 bp, Homo sapiens
attcagaaatttgtgggtggaagtggggcaaatgacttaaatgagtggaagattgtgaaatctgtgtgggcagtcaggcattgttgagaaggaacttctccagtacctgccagaccaggccttggaggctgagtggtgaggatcaatctggtctgaacggaggggtcgattgaagaacgttccttagaactgaagggcctaactacaagcagatccccttctccgctgtttcacttaccatggtttcgctttctgccatttcagttacccctggcaaaaagcagtctgaaaatagatgagttcagtacaataagatactttaagaaagagagagaccatatttacgtaatttttattacagtatattgttataattattctctgaggaaaatgggcggactactgtatatagagccaaagaattcattaaatacacagcaaaataaata

SEQ ID NO: 260058 - DNA, 416 bp, Homo sapiens
tagtattgcattaatagttgaggccatggattttattgccagagatcactaaagattgtatcttgacattgtcacttaatgccttagaaccactggcacatttcttaacctctccacgtctgtttcctatctgtaaaatgtgattcatgatagttttttatattgagatgttgtgaggaataaacaatacactgtaatgtatgtgcagcaggtttataatttttagacatgtcttttcccctttacatgttgtaaaactaattcaagtttggggcctagatttagctaacagtagcatcacatgggctgatgtctggaatccttactggaaagacagatgcttagtgaatttagagatcacaactgcatttatgtgttaaggtttttaacttaacctcaataccctttgatttttc

SEQ ID NO: 260059 - DNA, 303 bp, Homo sapiens
ttttattcttttccaaatacttatgatggtgcttagttcattttcagacttctttctttctaatgtatgtatttatggttgatagactgccctcaaaaatactggttttgacatgttacattttcattacaatttggctttaagtatttttaaaaattcattatgatttcttaattgagcaatgaataattaagtattctatttccaaagatgtgaggactgtaaaaatataattttgctattgacttttaccttaactgaatttttgtcaaaaatataatctttctttttattttatttttt

SEQ ID NO: 260060 - DNA, 675 bp, Homo sapiens
  misc_feature (519)..(519): n is a, c, g, or t
  misc_feature (575)..(575): n is a, c, g, or t
  misc_feature (614)..(614): n is a, c, g, or t
  misc_feature (675)..(675): n is a, c, g, or t
caataattttgtaagcacctaaatctctgcttgaaatccttcaagttgtttccagtttcttgtctgaacgttgaccagtgttgtccttaccttcttctgcatgcttcttttcttgtaaatgctatttaactataaatttactgctagatcccaggcccacccttcttgtcttcttacttaagacatttcctgggatatcacatatctacggcttctgttatcatccatgtgctgataactcccagtttaacatttccagcccagacccctattgtgaactcccaaattcagacagccaaatccagactggacatgttcacatgactatcttatgtgtatcctgccccaactactattgctttacaccaaactattggaacagcccgtgggagattccctccaactggtagcatatttttcaaaacaactagaccccatttagaaaggctggcctctttgctcattttgtccataccctctctattatccgtaggcacttcacatctatgaacccctcangtatttcttctacagtctgcagacatgctcagccatatgtgacacttcatctcatnctttctatgtaggcctacatgcaactctctttaactgtnttctctctcatagatgctcccattagctccgccactctttgcctcaacacgattatgcccn

SEQ ID NO: 260061 - DNA, 425 bp, Homo sapiens
acaaattcctaaaaaaataaataaataaattaccaaaaatgacacaaaagaaggaaaagaaaatctaaatgtttcagtgtctgttaaaaaaattgaatttataagcaaaacacttgccacaaagaaaactccgggcagatgactgcaccagtgaattttatcagacatttaagggggacaaagtaccaatcctacaccatttcaggaaacagagcagggagaaatacttctatactcattttatgaggcaagcataatcatgccaaattatttttcctgataccaaaatttgacattttgcaagaaaattatagactgatagtcctcatgaatatatatatatatataaattcttaagtattagcagattgaacttgcaatatagaggattacataccatgaccaaggagagtgaacttaacatt

SEQ ID NO: 260062 - DNA, 267 bp, Homo sapiens
gagaagaaagtatatgcagtgaattttataagcatgatatttacaactagaagacatttgaaatagacaaatgaaataataaagcttcgtagtacattagcatagcattgtattttgattttacagtagcaatttcataaaaatgtatcggtatagaattctgagtttggaactttctccaggacacggtgttttttagtacactgtgtctaaacattgggtataaagaaaagcataaggaatgtgtttaatgagtagcattactgc

SEQ ID NO: 260063 - DNA, 189 bp, Homo sapiens
ttgtacacatttatggggtatatgtgaaattttgttacatgtatattgtctgttggtattgttaagactttacttgcaatattaactttagcatttttgtctgttttattatccatccctgactcattcttgagtttttcttttatatttatatgaatttttagtttgtaaaagtgataactgactgca

SEQ ID NO: 260064 - DNA, 184 bp, Homo sapiens
ctgctgtttcctccctgaacgtttcttctccctggttcttgttcacagcccctgatatttcctcccaggctctctcttctgcccacccagcaaatgtttttgttccttacagttccctcctaaatgttctctgttctctcaccgtgttcttcatgagtgatgtaataaattctcaaggctctca

SEQ ID NO: 260065 - DNA, 183 bp, Homo sapiens
ctctttctttctttctttctttccttccttccttccttctgttttttttgtttaaaaaatttcaatcaaatttttaaaatttattttattttaaaataaaataaaaatgaataaataagggctgggcatggcggctcacgcctgtaatcccagcgctttgggaggccaaagtgggaggatcac

SEQ ID NO: 260066 - DNA, 626 bp, Homo sapiens
ggtgctcagcttcagtgaggtaagctgtgagaagtactactcttctctcatacccagtagagagagaaaacttgatcctttttctcatgcccatacacaatgatggttttaagatcttgccatcgagtgggaaaacccctagggcctagagcagaggctgtctgctcccagattctccaaagccacagagctcctataaggggaaggaccaggccactctttgtacgggtggaaaagaatgcaaggagaatatccatggaaaaaaagagatttataatctctcttctcctactgagatcatcactccccacatcacaattcaattatggccttcgcccatgacctagatgacccaggtcacttcatatttcttccttaggaatttctgtgtgtgtgtgtgtgtgtgtgtgtgtgtgagagagagagagagagagagagagagagagagagagacagagtgggcagggagtggtgagttaagccacataaagggcagggaaaatggggcatgaaaaaggtcaacagaagcagaagcaggccttgggatccccctagagtttaccatcaacaattgctccaatcatcaaagcctctacctaggaaaagtactcacttgtcttggaggc

SEQ ID NO: 260067 - DNA, 394 bp, Homo sapiens
cccaaaatgttaggattacaggcacgaaccatgtgcacagcctgtattgtgtatgctagagccaattactaaatctttctgggccccaagggtctcttttgcaagaaggacatagcaacttctcccttccagagttctccatcagaaagaggattgagagggtatgttatagaaactgttcaactctagtgcaaggttttaggagtcttcgtttccttccagttatttgagaaatgtggcttcttcaagcaactggaatactgaaagcctttttgatgggaatcactcctccctaaccacttccacccacaccttctttggtaaaacatttttgagaaaaattggttttgatctgaattctgaggaccaaaacagcctccaaaaatcaagcaca

SEQ ID NO: 260068 - DNA, 672 bp, Homo sapiens
tacctgccctattgacatccaccctagagttcaggatatcatacccattttactgttcccctggcacaattcatagtaaggaaaaacagacaaggggaaagctattagattctcggtgctgctaaacaggacacacaaggacaccattttgtgatgatgatggtgctttatgcagcttccaccatttacaagattttcctgtggtgtggaacctctcatgataaagcaaaggaactagaagcttattccagtcaagatttctgatttatcttgtggtaagcatttgggaaggacatatctgcacatgacctgagactaagtactatacactgaatcagatgaaaattgctcttaggaagcttacaattttccaaatagttaggacaaaaacaaactctccttctctcttcctatatgtacatactgacatctttatcattactgtcttcctagggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctga

SEQ ID NO: 260069 - DNA, 726 bp, Homo sapiens
caaacccctctccacacacaaccgcggagctgcctgccaggcctgctcactgcagagccgccgctgcctgcgggacgggcaaaagccaagccgccaggtggacctcggggaagccgccgccaacactcacctcacaggaccaggaggttccatcggggcgctgccgcgaatcgcgccacttacagccctcaccccaggggcaggtttgcgcctgcgcaggtcgcagcctcggcctccaactcccagaatcctcctcgccgccggcttccgttcgcggactttggcccaggcgcgtgggcgctgccgagaggctgggagcccgggaaccggttcctggacttgagcggagcgagaaagagcgcgccgcctgcacgactggactggagcggccgggtgccctggaggcccctgggaattgcagtccttgcgcaggtggagagatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctga

SEQ ID NO: 260070 - DNA, 459 bp, Homo sapiens
cagcaaaacttctctaccccggcctcgggcaggtgcccgcccggggagggggctgtcgtccaggccaggtacaactccccttcccacccttcactccctacccaagggtctcgagaaaagagaagaggaacatcaagacccccctccacggcacgtgacgcgacgcaacgcagatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctga

SEQ ID NO: 260071 - DNA, 494 bp, Homo sapiens
tacctgccctattgacatccaccctagagttcaggatatcatacccattttactgttcccctggcacaattcatagtaaggaaaaacagacaaggggaaagctattagattctcggtgctgctaaacaggacacacaaggacaccattttgtgatgatgatggtgctttatgcagcttccaccatttacaagattttcctgtggtgtggaacctctcatgataaagcaaaggaactagaagcttattccagtcaagatttctgatttatcttgtgggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctga

SEQ ID NO: 260072 - DNA, 747 bp, Homo sapiens
caaacccctctccacacacaaccgcggagctgcctgccaggcctgctcactgcagagccgccgctgcctgcgggacgggcaaaagccaagccgccaggtggacctcggggaagccgccgccaacactcacctcacaggaccaggaggttccatcggggcgctgccgcgaatcgcgccacttacagccctcaccccaggggcaggtttgcgcctgcgcaggtcgcagcctcggcctccaactcccagaatcctcctcgccgccggcttccgttcgcggactttggcccaggcgcgtgggcgctgccgagaggctgggagcccgggaaccggttcctggacttgagcggagcgagaaagagcgcgccgcctgcacgactggactggagcggccgggtgccctggaggcccctgggaattgcagtccttgcgcaggtggagagatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctgattacaaatctttgaacattca

SEQ ID NO: 260073 - DNA, 966 bp, Homo sapiens
  misc_feature (751)..(751): n is a, c, g, or t
  misc_feature (754)..(754): n is a, c, g, or t
  misc_feature (790)..(790): n is a, c, g, or t
  misc_feature (794)..(795): n is a, c, g, or t
caaacccctctccacacacaaccgcggagctgcctgccaggcctgctcactgcagagccgccgctgcctgcgggacgggcaaaagccaagccgccaggtggacctcggggaagccgccgccaacactcacctcacaggaccaggaggttccatcggggcgctgccgcgaatcgcgccacttacagccctcaccccaggggcaggtttgcgcctgcgcaggtcgcagcctcggcctccaactcccagaatcctcctcgccgccggcttccgttcgcggactttggcccaggcgcgtgggcgctgccgagaggctgggagcccgggaaccggttcctggacttgagcggagcgagaaagagcgcgccgcctgcacgactggactggagcggccgggtgccctggaggcccctgggaattgcagtccttgcgcaggtggagagatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctgaaaaaaaaaaaaaaaaaaaaaaaaanaanaaaaaaaaaaaaaacacaaaaaaaaaaaaacccggnggcnntttatgggggggggagcgaaaaaaagagtgtgtcaaagagggcacatgggtcaatgaagtagtatgccagagcacacagtttttttagacaaaaggggggtaaaatatcgcgggcgcccacccatagggggagggaataatatgtcaaaacgcagggtacacaggtataag

SEQ ID NO: 260074 - DNA, 480 bp, Homo sapiens
cagcaaaacttctctaccccggcctcgggcaggtgcccgcccggggagggggctgtcgtccaggccaggtacaactccccttcccacccttcactccctacccaagggtctcgagaaaagagaagaggaacatcaagacccccctccacggcacgtgacgcgacgcaacgcagatgagaaaactcaagactcagaaacaataaaggttacagagatgaaattgacagagcctgaatttcaggttatgattctgtatggtttctttggtgctgcattagacctgagctctgattgaaaattcttccacgctcgctacattccaaaactttatctccaatatgaatttccagatgcctcacaaggtctgagctccatctgaaggctttcccatgcttgtcacattcatagggcttttctccactatgaattctatgatgtcgaataaagtgtgagctctgattacaaatctttgaacattca

SEQ ID NO: 260075 - DNA, 663 bp, Homo sapiens
gtctcagtggtaactcaaggtcttcaaataaatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttcctgtccacaaccctaaaactcttctttatacttgtttcctacctgatagtatcaaaaaggaagattccttattaatctgtcagactatgttcccctgaaaatcatgttcccttctatgactggaggcattactgcagttggaagctcaattcttaataagtgagttctgctacctctaaattccattgaattctcagatataaagcaaaataatgtccttagagagagattctcccttcataaaaacagtcttagaaattggttttatgaatagccctctcctgtcatttgtccacacatggtcacacgttggctttggtttctagtaaagacaatcgtggccccttccccttgagaactggtaagtgcttatttagctcttcctggactaacggaccagtgaggagcctataaatacaccccaccagttccattttggccattggaaattaaaattggtttc

SEQ ID NO: 260076 - DNA, 881 bp, Homo sapiens
gtctgggaaatgcagtctagctgtgtgcctaagagaagaatggatttcagagggcagctaatcatcttttccacagcatgcaatcctaaactatagtattttcagagtagtatgatttagtatcagctgatatcttatccttcaatactagccttaaacctctgactggactttttggagcaactgagtcaagtgactttactttttaaaactctaggaaaaaatcatcaatgattcttgaatagttcaagtgaaattgtgaagtttaagaagtctgatcaacatggacagcaaatctaagctatcttgtccaaaaaagtgagactttaaaaaattatctgtttggttttagttaatgtggtgatttcagaatagaaatttcagccccacgccctgccccaaccttggcatctcagctccagtgatttgggaagttgggtttggaggtacctgtgattgaacctctgtctgattctcagcatttgtctcatccctctaggaatgattatcaaatggttcttttatatcactgtaaagctgccaccagaggagatttagaaatctcctttagaagttctcaaaaatagactagcatctcattttctgggtcgcttaaagtcaaaatcatgtccctaaagctattacaaacctatttctataaatttttcagggtaatcagattctttttcctagtggtacaactacttataaattataacattttaatcctaatgatactttaaaaggtgagcgcacgggcaatatttgaaagggatatgtgttccagagagggccaaatgttaagctgtgggagactgaaaccctaaaagcaaattggcaaagctaaatctatactattttgaaataaaatcataagaaaa

SEQ ID NO: 260077 - DNA, 420 bp, Homo sapiens
ggaggagaacagtggagagttggggagggagataaccatgggatgagagattccatttcactccaacaacacaccataggactcagggcagagagaagttctctcgcctaacctttttgagatttcccttaacaatgctcaggcagctgctggccccttgggatgccagagggcctagacatttcttctgtaaccacttccaagccagacagaccacccccttgataattttagcatttagtcaagagcgaaggctctgtagccagagttctagaatttaaatcacagctctatcactcacaagctatgtgatttcaggcaagtttcttaacctctctgggccttatctatacaaaaggtaaaattgttggtgtagagagtaaaatgaacccaatatgtgctgtgcttgcaacagtgcct

SEQ ID NO: 260078 - DNA, 493 bp, Homo sapiens
agttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgttt

SEQ ID NO: 260079 - DNA, 407 bp, Homo sapiens
atgaggtgaactatggggtaattttgtttgtgtagcctcatccacagccccaaggtaagaatcatcaaaagcagaatagatgttgctctatggggaacgcacacatgaacaatattatctcaagggaagggttgcccaaacagattcatctacatggcccaacaggttatactgctgagaaataagttcccttggagacgcaggcaccttttagaaaaatcccttttcattccccacttctttcaggcaaaaaaaaaaaggttttaaaaaatgtaaaagtaagagaaatggcatggctgttacacaataaagtgaacatacccaacagtacaggactgtatacttgaaaatgattaagatggtaaattttgtgtaatgtgtgtgttttttttttaccacaattaaaa

SEQ ID NO: 260080 - DNA, 446 bp, Homo sapiens
aacataaagtagaacggagaaagaagatgcaggcaggagcggggtcagtgcacagaatgcctgcacaacatggcatccagcgctgttgcccagggcggtcaccaatctgctctgaggcctgacacatgagaaaagagacagatgtgaagtggttgagattcatgttgtccatcagataagagtaaaccagttactcagacaagctttctgagatcacactgaaaactatacacttgcctagtaagtagtgcaatgaataatgtctgaggcaatattcctggcataaatgcagtggttagctttattcagctattttgaagacatcataaaatgcaattttatggcattgcagttcatcaaagtcacttctatgagagctagaacaccctggtgtaggtgcgtacttttctgcttatctaaagtaatctaagaagagcatttaaact

SEQ ID NO: 260081 - DNA, 2178 bp, Homo sapiens
ttgaacctatgatgaatgaaagaaatgaagtttcctatataggtggttatgtcataagtgttatatcataagtggtgttatagtatcattattacctactatcaggaataatttcttttcactctctcattattcttgtcactgttgaatgtctcaagagttgtgtgtgtattcagtttctatttccctctctgtctcatttactgactccagtctgactaatgctctaatatgctcttgagaagtcaccatgaactccatgttgctgagcccagtggacactttctgtcctcctacttaacctctctgcacagatagattccgtacagagagaaagttgatcacttcctctcttctcagcttctctgacaccaattctgtatttttcttctacccctttggctaatcttgatttttaagacactttgtgggctaacaaaacattctgtggaatgagttcaacatatattacaatttcccctttttaaaaatcatgttattctgtttcatttacagctcttcacattctgtattgatttttaaaaatattttaaaattgtttctctttcctccactttgaaagctttatgaaagaataatttctgtctattgcctaatactgtgtatcatcactgtgcttgacacgtagttggtaatctctaagtatttgagaagcagtgagttaattaatatttgcttttttgacttttttaggttatttaagtatttttgacatctctttttgggaatggggtaaaagaattgtagaggaactattaaatgaccagtgtaaaccattgtttgtaaatggttgtgtaatatgactttggaataatgcagttaatggttatcagtttaagtaatcactattcagttttgataagaaatgtgctttagtctttttctaaatcattctaggagatttgcccatggatttatacatagcaactatacacatatattttagatgaccagaaaaatttagtgcttcttcacagctgtcagctggaataattgcgtactcatacaacaggagttaggttagaactgctattatttagtatccttttgctattacctgatgtagtaagtttaacatctttgtaaaaatatgttttaagttctgggccattgattttgaagtgggaaataaatgaatgctgttgttttttcatgtcaagattaccaaaaagctctatggaaagttattttatagcaaacacaagggaaaggtattttccagaatgagttttttacaaatggatagtgatgttttctgtaatacttaagtttagaaacatatatcacatgacaagtccattgtttattcaaaaaacaaataggcatttgactcatttgggactgtaaaatcttcaaaaatatgccagaaaactaaaaaatgtagaaaagaggattttttttgttttgtttttagcccccagaccaccactttttatagtaacttattttctagtgtctcaaaaaataagggcttttaaggaaagagagtatttctcttaaagttaattttgatagatatttatctagatgctttcttttttcccttgccataatagctggcttgtagagagagttatgtttgaaaaggcttgccttttttccgtcgctctgagcaggattatgttagggcccaaatagtgactttgacaaaaaaaaaaaaaaaagggggagtatattagttttaagtttgacagcataaaacaaaactcaaaaataaaagtggcttaaacaaaatagaagtttatgaaagaagactggagacaggtaggaacgggtagtcattaaggaccagtttcctcttcttcctatcatcatctggcatggccagttgactttatggacaactgtgcctacaggaccttctgccattgcatcagtatccttaggtagcagcaaagaggaagtggatcaatgactccacccttcagttaagccaactacctataagtgactttcccagaaagtcccacacatttgcacccattagccaaaactcacacacatagtcatacctagctataagggaaactggaaaactaacctagatgaattgctactccaaatcaaattggggatccattattgaggaaggaagagagtgtgtattggataggaaaatagcattctcttctatagtgagagaagtaatagtttttg

SEQ ID NO: 260082 - DNA, 440 bp, Homo sapiens
gaagctgtgaagtagccttcagatttctcatgtgagtgcctgagtaggtcatgttgccattggctaaaatcagaaatgatggaacaggagcaagtttaaggggtggaccagatttatttatgcacctgccagatccacacactttccttgctttctggccacagaggccctagcgaccacccacacagggcacagttcccatggtcccgaagacaggtggctgtgcctacaagtagggttctgagggtttgctggccctgggtccttgtgtcacccaaggatttgaccaagcataccctcacaccgcaggattgttgccccagagacaaatgaggttgctgggcccgggtggccccacacgctcacgttgcccactcaggcaggcagtgtcttactacaaggatgtttgtcattcctgcttgctgggagggggagttgga

SEQ ID NO: 260083 - DNA, 554 bp, Homo sapiens
acctgaggatcccgagctctcttgtggggctcaagacacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccacagagagagcgtcgacgctctctctgtggggtcatgggctgggcccagggtccccaagctatgtgcagcctggggtttgtccactgcatccagctgcccagctgtggtgaggctcagtgcggcaaaaca

SEQ ID NO: 260084 - DNA, 5845 bp, Homo sapiens
ccccccgccccggcccggcccggcccggccgcagccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccaggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagggtttttg

SEQ ID NO: 260085 - DNA, 530 bp, Homo sapiens
gccctgaggacgcccggaagaaggtgccagctgcccccatcactgtcagcaaggaggcaccggcccctgtggcccacccagctccaggtaggggctgcctggcaggggctcagggcagctctagacggcgggtagatcccacagcacagggatgggggctgagtgtggagactggattctgtgcctggcgtctgggccacccagcagcccccacaagccttcgaggcccctgccttacccacaggtggccctgaagagcagtggcagagggccatccatgagcgcggggaagccgtctgccccacctgcaacgtggtcacccggaagactctcgtggggcttaagaagcacatggaggtgtgtcagaaggtaaggcagctcccggaaggcgctgggagggaggcgccctggccccaggcaggcttctcacatgtgggccatctgcagcttcaggatgcactcaagtgccagcactgccggaagcagttcaagtccaaagccggcctcaactaccacactatggccgagca

SEQ ID NO: 260086 - DNA, 326 bp, Homo sapiens
ggaaggatggcagccgaaaggaggtccgacttccaatgctgcatgacccaccgaagatgggtaagaggagtcagggccagagtcaattccagatggttctgggcagcaagtggtaggagtggaccattgccctgggcgtcctgtctccaggtacccagctaggcccctagagttcccaaggaccttaccagggtaggggttgccttggacatagcccagggtcctgggttcttgtcctcagctggccgcagcccctgcccccggtgccctcgtgttgggacagcggtgctcactgtgggcctgtgcagccgccggtggtaggcggt

SEQ ID NO: 260087 - DNA, 517 bp, Homo sapiens
gtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaaggtatgggggctcgtcccaggtcggggaggaacagtggtaagaaaaggtatgggggctcgtcccaggtcagggaggaacagtggtaagaaaaggtatgggggctcgtcccaggtcggggaacagtggtgagaaaaggtatgggggctcgtcccaggtcggggaggaacagtggtgagaaaaggtatgggggctcgtcccaggtcagggaacagtggtaagaaaaggtatgggggctcgtcccaggtcagggaacagtggtgagaaaaggtatgggggct

SEQ ID NO: 260088 - DNA, 5925 bp, Homo sapiens
ccccccgccccggcccggcccggcccggccgcagccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccaggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagaggttccagctatcacttgtaaccatatatatatacatatatattctatctacaaagtgtttatttgcgagatgtttcaacggtgagttcgggccccgcccgccttgtgaccatctgtccccggtcctcgtccccgccccgcgccctggtcccgagtggcgtggggacgggccatcactgtatgtattaaaatgactgtatcaaataaatgtttattgatttttttccagggtttttg

SEQ ID NO: 260089 - DNA, 4608 bp, Homo sapiens
ccccccgccccggcccggcccggcccggccgcagccccgctgggcgccgcagagatgacggatcctttctgcgttggaggccgtcggctcccggggtccagcaagagtggtcccgggaaggatggcagccgaaaggaggtccgacttccaatgctgcatgacccaccgaagatggggatgccggtggtccgtggtggacagacagtgcccggccaggcccctctctgctttgacccgggaagtccagccagtgacaagacagaagggaagaaaaaggggcggccaaaagccgagaaccaggccctccgagacattcctctctccctgatgaacgactggaaggatgagttcaaggcacactcgagggtgaagtgtccaaactcagggtgctggctggagttccccagcatctacgggctcaagtaccattaccagcggtgccaagggggtgccatctcagatcgcctggccttcccctgccccttctgcgaggccgcattcacctctaagacccagctggagaaacaccggatctggaaccacatggaccgacccctgcctgcctccaagcctgggcccatcagcaggccggtcaccatcagccggcctgttggggtcagcaagcccatcggagtgagcaaacctgtcactattggcaaacctgtgggtgtcagcaaacccattggcatcagcaagccagtctcggtcggcagacccatgccagtcaccaaggccatcccggtcactaggcccgtgccagtcaccaaacctgtcacagtcagcaggcccatgcccgtcaccaaggccatgccggtcaccaaacccatcacagtcaccaagtctgtgccggtcaccaaacccgtacctgtcaccaaacccattacggtaacaaagcttgtgacagttacgaaacccgtgccggtcaccaagccagtgacagtcagcaggcccattgtggtcagcaagccggtgacagtcagcaggcccattgctatcagcagacacacaccgccctgcaaaatggtgctgctgaccaggtcggagaacaaagcacctcgtgccacagggaggaacagtggtaagaaaagggctgcggacagcctggacacctgcccaattccacccaagcaggccaggccagagaatggggagtacggcccctcctccatgggccagagctcggccttccagctgagtgcagacaccagcagtggctccttgtcgccaggcagcaggccgtcagggggcatggaggcactgaaggctgcaggccctgcgtccccgcctgaggaggacccggagcgcacaaagcacagaaggaaacagaaaacacccaaaaagtttacaggggagcagccatccatctcagggacctttgggctcaaaggcctggtcaaagctgaggacaaggcccgagttcaccgctccaagaagcaggaggggccaggccctgaggacgcccggaagaaggtgccagctgcccccatcactgtcagcaaggaggcaccggcccctgtggcccacccagctccaggtggccctgaagagcagtggcagagggccatccatgagcgcggggaagccgtctgccccacctgcaacgtggtcacccggaagactctcgtggggcttaagaagcacatggaggtgtgtcagaagcttcaggatgcactcaagtgccagcactgccggaagcagttcaagtccaaagccggcctcaactaccacactatggccgagcacagtgccaagccctctgacgccgaggcctccgaagggggcgagcaggaggagcgcgagaggctgcgcaaggtgctgaagcagatgggacggctgcgctgcccccaggagggttgcggggctgccttctccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacggctcaactacactcgaccagggctccccacgctgaacccccagctgctagaggcatggaagaatgaagtgaaggagaaaggccacgtcaactgtcccaacgactgctgtgaagccatctactccagcgtgtccggactcaaggctcatctcgccagctgcagtaagggggcccacctggcagggaagtaccgctgtctgctgtgtccgaaggagttcagttctgagagtggcgtcaaataccacatcctgaagacccacgcagagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcacttgtgaccatctgtccccggtcctcgtccccgccccgcgccctggtcccgagtggcgtggggacgggccatcactgtatgtattaaaatgactgtatcaaataaatgtttattgatttttttccagggtttttg

SEQ ID NO: 260090 - DNA, 725 bp, Homo sapiens
gctgtgtccagccctgcggcaggtgcctgcctggtcctgaaggctgtgtccagccctgcggcaggtgcctgcctggtcctgaaggctgtgtccagccctgcggcaggtgcctgcctggtcctgaaggctgtgtccagccctgcggcaggtgcctgcctggtcctgaaggctgtgtccagccccctgctgcaggtgcttgcctggtccagaaggctgtgtccagccctgctgcaggtgcttgcctggtcccgaaggctgtgtccagccctgctgcaggtgcttgcctggtcccgaaggctgtgtccagccccctgcaggtgcttgcctggtcccgaaggctgtgttcagccccctgctgcaggtgcctgcctggtcctaaaggctgtgtccagccctgctgcaggtgcttgcctggtcctgaaggctgacaggtcttcagctctcaggctatgcctggctcaggtgctcagcatccagtcccaggtcttcatcagcgcttttctctccccagaactggttccgaacatcagcagacccacctcccaaacacaggagccaggactcattggtgcccaagaaggaaaagaagaaaaatctggcaggtggaaagaagcggggccgaaagcccaaggagcggaccccagaggagcctgtggccaagctgcccccgcgccgggacgactggcctccaggatgcagagacaagggggcccggggctccaccg

SEQ ID NO: 260091 - DNA, 358 bp, Homo sapiens
gaggattcgaaatcacgtgccgcgacaagctagagttactcctccaagccaccaggtgtcactggtgtgccaaggcggcaacgaagccaagttttcccggtggatgcggacactggaaaccagcaatccttttagttccccaacctggttgcccatcagaattccttgagaaatttaaataataattcttggaaatcacttcagacccactgaatcaatcgaggcccagaagtgagtatctaaaaaaaattgttatatggaaattgtcattatttgggatgtgtgtgctgggggattgctgctgtatattatatctctatttaaataaatgtcccaggtgattctgtagttgcagcag

SEQ ID NO: 260092 - DNA, 207 bp, Homo sapiens
ataaaaatgggaaggaaggtagtaaggtaagatgagaactttttccagcagttctctttcttgtactaaccctagtaacattgatgttatctcaattttcttttcttttctttttttttgagacagagtcttgctctattgcccaggctggagtgcagtggcaccatctctgctcactgcaagctctgccttctgggttcacgccat

SEQ ID NO: 260093 - DNA, 437 bp, Homo sapiens
aagaaaatttcttgaaaagttctatttcttcaatcatgcctcccacaacggccaggccagcaccgcagagctgggccgcccgccgggacacggctccgcacacctccttcaccacgatgctgtcctcacacgtgctgtccaggcccagctgctgcagaatcctcctgacctggagaagggccagccgatcgctgcaggcaatagagcagggagtcaggacctgcttcccaggaccccgggatgtgcccagtgtgacccacagcctccccattcttagatgcccttacaggagggaggagaaattgacccaggcaatggctaggctggagcagaatgccttagaagccgagactcaagaaggtccaccacccctggaagttccatcaactttaaaaaataaagtgtgaatgcctctggtgttcagcatgttcatatct

SEQ ID NO: 260094 - DNA, 280 bp, Homo sapiens
gtgaaaataagaacaaagagacagagagaagagatgtgacacacctttaaacaaccagatcttgtgagaactcactcacttttttgaggacagtaccaagagaatgatattaaatcattcacgagaaatctgaccccatgattcatttccctcccaccaggctacatctccagtattggagattccatttcacatgagatttgagcagggacaacatccaaactatattatttaatgatatgagttttctcattagacgcacctgagaaatacaaccttc

SEQ ID NO: 260095 - DNA, 660 bp, Homo sapiens
accttttaaaactagtctcatgaaggaagaacagctagcctgtctttctatgtggacatccgatatatttgtccctatcttttctctggcaatgacactgccatttcttttgggaaactggctctcttccattccttgtcattctggtagaggccaccagttacagtatctgtgttcctcccttgccatggccccattgacttatccaggaacatggatgtgactcaagcaaggctgatccatggacctggaaaagaggaggtcttcctccttcttgggtgttacaaactgaagtgctacaaatgtagagccacctgaggcctctgtccatgccatggaggagggccatacatggtaagaaagaagttgaagctaacatccagaggaaagcagagttgagagatggaagagttgcaaaaagagtttgagagatggagcgataggttagtagatagatagatacctgatgacattcttcatctagataggcttgcattaggttccactcttggtatttgtggctacaataattcacctttgttcttatcttaaattgctttgttgtagacttgtagccaaaaaagtcttgactaatccactcacccattcagcacagaaaagtactcctgatgtgcgtcactttacaacaaagccatcctg

SEQ ID NO: 260096 - DNA, 416 bp, Homo sapiens
  misc_feature (2)..(2): n is a, c, g, or t
  misc_feature (7)..(8): n is a, c, g, or t
  misc_feature (10)..(10): n is a, c, g, or t
  misc_feature (13)..(13): n is a, c, g, or t
  misc_feature (18)..(18): n is a, c, g, or t
  misc_feature (20)..(20): n is a, c, g, or t
  misc_feature (23)..(23): n is a, c, g, or t
  misc_feature (29)..(30): n is a, c, g, or t
  misc_feature (32)..(32): n is a, c, g, or t
  misc_feature (36)..(36): n is a, c, g, or t
  misc_feature (40)..(41): n is a, c, g, or t
  misc_feature (62)..(63): n is a, c, g, or t
  misc_feature (66)..(66): n is a, c, g, or t
  misc_feature (69)..(71): n is a, c, g, or t
  misc_feature (75)..(75): n is a, c, g, or t
  misc_feature (78)..(78): n is a, c, g, or t
  misc_feature (80)..(80): n is a, c, g, or t
  misc_feature (82)..(83): n is a, c, g, or t
  misc_feature (236)..(236): n is a, c, g, or t
anggttnnantantttanantcncaccannanttanaagnnttccatttctccacatcctcnncancannngttnttncntnncttttaatgatcaccattctaactggtgtgagatggtatctcattgtggttttgatttgcatttctctgatggccggtgatgatgagcattttttcgtgtgtctgttggctgcataaatgtcttcgtttgcgaagtgtctgttcatatccttngcccactttttgatggggttgtttgtttacattatctttctgacatcatttaaaatattaaacgctttaatatatggcacctttaaaattgagtcagagccttttagtgaaagaatctgttttcctaaaatagaaataactttaatatttaatagcttcaggtttatacactccattttt

SEQ ID NO: 260097 - DNA, 367 bp, Homo sapiens
cctgaatttaaattttggcctctccagctacatgggggaatttcttatagataatattttgaagtatgtttttcaggttgtttccattcttctcatttctttcaagaatgctagtgagtcatagatttggtctctttacataagcacatattttacagagattttgttcattctttttattctttattgttgtcttattttggaaagccggtatttgacctcttagtctttttttatcagcttagtctgttctgctttgatatttgcaagtgcattatgaaatttttatagtgtgtcattcagctctatcaggttgattatgtccatttttttttttttttagagtctaactgttacccagagtgga

SEQ ID NO: 260098 - DNA, 461 bp, Homo sapiens
gcatatatgggtgtttgcactctatctttctgtctctatctagtgaggaaacttgactatcctatttttactttttaaattgttaacaaattaaaacttaaatgtttatattaatgtctacagttgatccaagtctccattcaagctgggaaagaacattatcatgctttcaattattcttttcctagcatctccctaaagaagtcatctggaattttaatacttgtttctcttgtttcttttacctttttacattatgttttaatgattttgcatccttgcctatcaattttactgatttctttggcccaacactattttttgtataacacatctttttcctggattcattattattttgtgggagtacttaaggaattctttcagataggctttatggctgataagttttctgagtccttacatatacaaaaatgtcttttacctggggtgtggggagg

SEQ ID NO: 260099 - DNA, 1306 bp, Homo sapiens
gtgctaatggcagttcaaaggtgagtgtttcctgtaagttgggccagcgcccagcctctgctcccccagaacctgggagggcagcacccaagataacctgagcaccccgttaccttggagccctgaggctgtctctgggccacccactcaaggtggcccccctacctgctcaaggctacatacagagggctgtcctgcccaaacagccacacccgagggccgacccagtgctctgtgtgccaagggagtttctggcagagccacctgataccccacgtgacagctggcctctcccccatcacccaggggctacccaggcagagagctgagaacacaggggccatcagcctcgctatcacctccacccccaagtgcttggctccccaagggacagctctaaaatccccagaatctcaggctggtgggtccagctgagcatcctagttttcactttctcctcccaaaaaggaaagaaccttggtcactaaattctacgccttctggaaatcactctgctaatgacttcctgaatgatcgactgagaccaacagctggcccagccctgcatggaggagtaagaaaccctcatctgtcagagttaaggggcctgaatgggtacaggtcacattcttggagctcaaggtgacaggccagagcccaggtccccaggacagtgcagcaccttgtccaggcgggcctcccgtttctggctccgggctgagcttcctggagaagaggaaggttcatctgaattgcagaaactggaagcagagagcccagttaggagctactacaactatccaggcaagaaagacagtggcttggatggggatgtggtattgaaagtggagactagcagaggtacttggaaatgtacatcttatagctaccaagacttgctgctggtgtgaatgttcaggtaaaagagagagaaatcaagaatggctctaggctgggtgcagtgactcatgcctgtaatctcagcactttgagaaccgaggcggatggatcacttgagctcaagagttcgagaccaaccagtctgggcaacacagcaagactctgtctctccacccctcaaaaaaaagaaaaaaggaaaggcatgactctgagggtaaattctaggaaggcatgtggggtgggaaatggggccagcggtgtgattaaagaatgtacatggtagtagagggatgcagatctagataatattgaaaggccaggacttggacttctgggaatgggaaacatgatagaattatctgtaattttccagaatcaatgactagttgtttttttaaaaaaagaa

SEQ ID NO: 260100 - DNA, 724 bp, Homo sapiens
tgtaatcccagctactcaggagactgaggtaggagaatcgcttcaacccaggaggtggagattgcagtgagccaagatcatgccactgcactccagcctgagcaagagaaagacttcgtctcaaagaaaaaaaaagtgatatgatttatgttttaaaaggttcatctgaattgcagaaactggaagcagagagcccagttaggagctactacaactatccaggcaagaaagacagtggcttggatggggatgtggtattgaaagtggagactagcagaggtacttggaaatgtacatcttatagctaccaagacttgctgctggtgtgaatgttcaggtaaaagagagagaaatcaagaatggctctaggctgggtgcagtgactcatgcctgtaatctcagcactttgagaaccgaggcggatggatcacttgagctcaagagttcgagaccaaccagtctgggcaacacagcaagactctgtctctccacccctcaaaaaaaagaaaaaaggaaaggcatgactctgagggtaaattctaggaaggcatgtggggtgggaaatggggccagcggtgtgattaaagaatgtacatggtagtagagggatgcagatctagataatattgaaaggccaggacttggacttctgggaatgggaaacatgatagaattatctgtaattttccagaatcaatgactagttgtttttttaaaaaaagaa

SEQ ID NO: 260101 - DNA, 665 bp, Homo sapiens
gtgacagctggcctctcccccatcacccaggggctacccaggcagagagctgagaacacaggggccatcagcctcgctatcacctccacccccaagtgcttggctccccaagggacagctctaaaatccccagaatctcaggctggtgggtccagctgagcatcctagttttcactttctcctcccaaaaaggaaagaaccttggtcactaaattctacgccttctggaaatcactctgctaatgacttcctgaatgatcgactgagaccaacagctggcccagccctgcatggaggagtaagaaaccctcatctgtcagagttaaggggcctgaatgggtacaggtcacattcttggagctcaaggtgacaggccagagcccaggtccccaggacagtgcaggtgagtagagcaagcaccgatctagggctaagatggggtctgaatgaccctgtaaggttccccacctgatttcccaggtgggaccctgaagtcagagagaggcctgagagttgcaggggggtgggggaccggtgttggtgttaatctgcctttacttcaaaacccagaagactcccaactattggaaagtgaaacctccaaaagcaaagccaccacccatcctccttccccactctgattcagacatgttttccctgcccca

SEQ ID NO: 260102 - DNA, 456 bp, Homo sapiens
gccccatatccttatattcacctgcctagctgactaagctggatgtctcaagaaacctcagacttgacatactgaaagccagagtcgtgattctcctgctacatctcccactgccttctcacccgctgcctgatcctcctccagtgctgcctgttttgtgaatggcataacctcaaacctcagttctgcacgccatcaactgggagtcactgtcagctcttcccttttctctaccgccttacatccagcccatcaccaggccctgtctacctcctaaacagcacctgggtccatccactccactcctccccatctccacagcctccacactagttcaggctgactttgccttttcctcaggctgctggaatcaccttctcattggtatggctgtatccactcttgcatctccaattgtcagggaggccaagggaaaagaaagtgtcagaaaaaaac

SEQ ID NO: 260103 - DNA, 208 bp, Homo sapiens
atgtcagtgactcttcactgaaaccccccaggtaggcatgcagtgacaatccagggctttcctggacacattgcaatcctaacctcagggtaaaagccatgtccctgttccgccacagcatggcaaaatcaattccagttggattaaaaagttacatgtttttaaaaaaatgaaaccgtaaaaatgtatgtgactcagataaagtaaa

SEQ ID NO: 260104 - DNA, 167 bp, Homo sapiens
agggcggtcttcagcacctcttgtaaagcagtattaacctccattacacctccagcagcaatgccttcctcggccatggcagtgggttacgggtgaacctgaatcttgaacgcacccaagcctccgcctccgcgcgactcggcggcaggagggaaagggcgagaact

SEQ ID NO: 260105 - DNA, 415 bp, Homo sapiens
ccctgtctcccaggattgttgactaagcagcccacattttcttcagggcagcccctctgctccatctgcaccccttccccgcacccatgcagttattcccctgcccagtggcctggtctccagggctcagtcagggtccccgcaaagactgcaggatggtttgggtggttctgggccaagctcaggtcctctctgcggtctttctgtcatctcacattgtcctgcagcctggggcagaggagaggtaaacccatggatccccacagatgaggtttgtactggcaaacaaagaaagcctgctgttgaggtaaattttttttcccaagtccagacagagaaacagccagtaactttttacttttggatggtattgaaaaataaaaaaagcaaaaattgtccattattttgttattta

SEQ ID NO: 260106 - DNA, 216 bp, Homo sapiens
cacataattctattaaagtaatgttgaatttggatttgttgtagaaaacttgcaaagctcttctaagagtaactaaaatcagtaaagaataggggaaaaaatccagagaaaatataagcaggaaaaccatagcagacagggtcagatggaatattagcggtttaggtgaagaacccagagaaccgcctgccctgtaaggaatgctgggtatttctc

SEQ ID NO: 260107 - DNA, 391 bp, Homo sapiens
atttaggcagaatgatcaatattgatggtttttttttccttaaattttttgctaagaacggccttcctgagtgcttaattggccttgaaatagtctaaattaggaaacttgaaatcttgaagtcatctaaattatgcaggtaattcaggtgagaggatcacttgaaatacttgtatgtgactagggccaaatctagttaaaaaagtgtatgttagttccttattccaagatatatcatgtatattttggatagctaattttaaagatatttacctgaattaagagttcttttaacaaagcataatgtggtaattcatcaaaagcctataataaggtaagcatattatttaacagtagactgccttgtttctgtttgctcatttgtttcttc

SEQ ID NO: 260108 - DNA, 672 bp, Homo sapiens
aatggtgccctggagattgtagtggtgatacctaaagcctggaaaaaggaggtcttctcgggcccgagaccagtgttctggcctgtcacagtggcgctacagtgcctggagctgcgctggtttttcctcggagtggagcctggtaaccgcgacttccccgccatgttctgtgtgttgctggctggagaagggtggttgacaaactccgacccagcacagtgtttctgtgggtcaaaactagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggaggtaaaccttgtctaaaaaaataaactatccaagtgtacaacagggagggactgcttaaagaaaacatgataattgtatgttcaaatacttttaacaagtgcaaaatgtataggctgaaataaatagggctggccgggcacgttggctcacgcctgtaaattccaacattttgtgtgctcgaggcattccgatcagtagacatgggtgaaaccccatgtctactaaaaatataaaaattaggcca

SEQ ID NO: 260109 - DNA, 677 bp, Homo sapiens
ctcaggcagcggcttgagttccatgggagcactgtcctgctccctctgctgcctctttttagtcttggggctactataacactttcccttccccagccctgccaacctggtgggacattgggcttccctcttcctggggacaggcgggtcctggggacaagcctgtcctgtatcatacctgcagcgagactctttttttctccaggacctgcggagcagccaggcttcatgagttaaatgcagatctgaaccatacccagttgggattggggtacacactctactcctctgaaaactagctaggggttcgaacttggtgagagggagagtgggacagagccagaccagacaaggactgatcacctggaaaaacctgccatcaaagaccttgacgagtgctgggggcggtggctcatgcctgtaatcccaacactttgggaggctgagacaggtggatcgcttgaggccaggagttcgagtcccgcctgggcaacatggcaaaaccctgtctctactaaaaatacaaaaattagctaggtatgctatgctcctgtaatcccagctactcgggaggttgaggcaggagaatcgtttgaactggggaggtagaggttgcagtgagctgagattgtgtcactgccctccagcctgggtgacagagtgagactccgtctcaa

SEQ ID NO: 260110 - DNA, 900 bp, Homo sapiens
aatggtgccctggagattgtagtggtgatacctaaagcctggaaaaaggaggtcttctcgggcccgagaccagtgttctggcctgtcacagtggcgctacagtgcctggagctgcgctggtttttcctcggagtggagcctggtaaccgcgacttccccgccatgttctgtgtgttgctggctggagaagggtggttgacaaactccgacccagcacagtgtttctgtgggtcaaaactagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggaggacctgcggagcagccaggcttcatgagttaaatgcagatctgaaccatacccagttgggattggggtacacactctactcctctgaaaactagctaggggttcgaacttggtgagagggagagtgggacagagccagaccagacaaggactgatcacctggaaaaacctgccatcaaagaccttgacgagtgctgggggcggtggctcatgcctgtaatcccaacactttgggaggctgagacaggtggatcgcttgaggccaggagttcgagtcccgcctgggcaacatggcaaaaccctgtctctactaaaaatacaaaaattagctaggtatgctatgctcctgtaatcccagctactcgggaggttgaggcaggagaatcgtttgaactggggaggtagaggttgcagtgagctgagattgtgtcactgccctccagcctgggtgacagagtgagactccgtctcaa

SEQ ID NO: 260111 - DNA, 852 bp, Homo sapiens
aatggtgccctggagattgtagtggtgatacctaaagcctggaaaaaggaggtcttctcgggcccgagaccagtgttctggcctgtcacagtggcgctacagtgcctggagctgcgctggtttttcctcggagtggagcctggtaaccgcgacttccccgccatgttctgtgtgttgctggctggagaagggtggttgacaaactccgacccagcacagtgtttctgtgggtcaaaactagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggagagacggggtttcaccatgttggccaggctggtctggagctcctgacttgaagtgatctgcccacctcggcttcccaaggtgctgggattgcaggcgtgagccactgcgcctggccccttcaggtgggtattgaggcttcactacaatactagttccccgttgctgccgcaataaattaccacacacttagtggcttaaaacagcatagaggtattcctttacatttctgaaggccagaattctaaagtcagtcccactgagtcaaggtgggagcagggtcagtgcctttccaggctctgcgggagaatccgtttcctggccctggaggcggctgtactcctcagcttgtgctgcccttctcgaatgactcgcgttcctgctttcatcactacacctcccaccgtctccatcactgctctggtct

SEQ ID NO: 260112 - DNA, 403 bp, Homo sapiens
ggcatggtggtagtaaaagtcagatttcaagaggactgacaactgattaggtagtgaagtcaaggcactctgaagatatttgagagagaggggaaggcaaggcagtgatacatggttatggagggagggagaaagatcagaatttaagagaagcacacatattcatatcttggtggatgtcatgtttcccaccaattagtaataaccctgctttgaggattttgtggcatgctggtaagttatcattttaatgccctgaataccctcttccctaacttggagttcctatccttcattttgaaccctcagttagtaggcttatttgttgtaaatgaggactagaatttgaacattatggaaaattactttttgaagagaaacattacttttattattacaggcc

SEQ ID NO: 260113 - DNA, 390 bp, Homo sapiens
cagacaatgggtaggtatttccaggcacagaaaagcccatctagaatgtacaggtctaaaaaaatatcagaaacctgagaaatacgaggagaaacaggatgctcgatggcaaaagaggaacctaacacacacatctctgagacttgagaggaaaagcaacaggattcatactatgtattgggattaaaattcttcagaaggaaaaccaaagcagtaatactttttaagaagccttatcatattagaataatttagaatttttataggtagaaacttggccgggcatagtagcttatgcctttaatttctgcactttgggagatgggtggatcgcttgagctcaggagtttgagatcagcctaggcaacatagcaaaaccccatctcaaaa

SEQ ID NO: 260114 - DNA, 717 bp, Homo sapiens
  misc_feature (3)..(4): n is a, c, g, or t
  misc_feature (9)..(9): n is a, c, g, or t
  misc_feature (11)..(11): n is a, c, g, or t
  misc_feature (22)..(22): n is a, c, g, or t
  misc_feature (534)..(534): n is a, c, g, or t
  misc_feature (695)..(695): n is a, c, g, or t
  misc_feature (700)..(702): n is a, c, g, or t
  misc_feature (706)..(706): n is a, c, g, or t
  misc_feature (708)..(708): n is a, c, g, or t
  misc_feature (712)..(712): n is a, c, g, or t
  misc_feature (715)..(715): n is a, c, g, or t
ttnncctcncnaaatgctgggnttacaggagaaagccacagtgcctggtctggtatgtgcattttctgacttactcctcaccatcgttattttgatgcttctagtatagttcctacataggtttctgtatcgttaatcttatcaatctatatataacatgcactgtgtaggcaagcttctctcttcatctttataaatcccctagtgatgctccccttcccactaatctccttcaattgagattcaactgcacaggccagcccctgtcagatctgctgtgctaataccactgggaatatttgttttgtgtgcttttttctctttccatggattaggtacactttcatcattttcaaaggaagacctgaatagcaatgaactcattggtcaagagcagtggagttttggcatggaataccctgtaccctggacccaccacgatggagtaatgtggagactcaaggctgattcttagccaggccagtggcttcagaaagggccaggagcctgcagttacacagctccatctttctncccctccctccaccccctgccttttatttcttatttgttacagcctttcatgaggaacaacagtcagtaacacaaacattatattcatctctgctcattctcccctccagggaccaaacaagttttttttctgggcattgaaaatacgtctcaccccagcntttannnaggntnaatnagnca

SEQ ID NO: 260115 - DNA, 641 bp, Homo sapiens
cttcagctgagattaacttttaagggctttattaaactgttttagccactagcaacgatttcccttacacagatacatttagattgactttgcacatcttgaaaataagaaacaaatgaaaataccagagtatctttatatgtataagttgtgaaatttgaagtctgcattacttcttattggttcagttttcatgggattatttatgtataggagcagccaaggaaaagaccatagcagatttttgtaatgatggaatgagattcctggcctgtcaagccagtaggtgtgggactatggagaaagttcctaaattttagtccagttatttgaatggaatcttgaagagacatttactattcatagagcaacctgagctcgaactgtaattttgttctagttgggcagtgggggaagagaagagacttgaaactagtgttatatgatggacacgtcagtgctgaaaattcacggtgcctgaggtaggttaaaccttcctccaaccaatggtttccatgcaagctttttaacacagtgatgcctatcctatatttttactatttgcacatattacgagcgattgaaggatgttaggaagctctgacaataaaaatggttttctttaatgaaaaaaaaattct

SEQ ID NO: 260116 - DNA, 343 bp, Homo sapiens
cacaaaggagaaacaaagtcatgactttatgacaggtggtagttttgaacttggagcaaggtagccacaaattaggcttctatcttcccaaagaaactggagataggggtgccatatcccttgacgtttacatttcaaaaggatggctcccagacctttgagaaagacattcttgggttgtaaaactggcaagaaacttttaaaaatatttacatatatctcgaagggcagagaaagaatttataattataagtttatactctaagaaataagcattatataatagtatagatatatcctattacatttccagtattcaatataatattattaactatagtct

SEQ ID NO: 260117 - DNA, 552 bp, Homo sapiens
ttccagctgagttatgctcagtttttaagagcttatctttatattttcaaatgacatttagagatttcccaagcatactatgtcctttacatatacttaaaatagtggatgaatataagttagtcttctcttaatgaagtcggatatacttaaaaaaaattgttaataatgaacagcaatagaacaaagatttcaagggcaagtaaactctttgaaatatgtttaaaaatattaacctttttgccttcccaccaaatgatcttttttgtataatttgatttttttatattttgttttcattcacagtcaggcaggctatgcctgtctaggtgagattctaaagagcagaactgtctcattgtcatcatacgtctccactcatctactcaaggacatgttcttgatctctatatctgccaccagcagttcccaagttcttcccaatctgtctctcttatttactacatgtaagtttctgtgagctgaaaagccatcttgccaaacttgcaagaattttgttcaaaattaaactaggtttgaagataaaaaaaa

SEQ ID NO: 260118 - DNA, 479 bp, Homo sapiens
caggtgataatagctatgatggaagcacccacagaatgtttgaaaagatttggcaaaagtggggccacagtgttgcctttggcaacagctaggtgaagctgatcagcagccatccctttgggtaggtccatgctccatttctccactgtcctcaccaaggccagactaggtcaggcaaacaaggcccaagaagccaactttaaggaggcactcatctcccattgctagccttgtacttgcaaagccccaagagtgagtgcttccttaaaacatgcatcctgggcaccttcctagccttgccctagccctagtcctgaccctggtctccaacactccctactgcctccccaacagtgaggccatgtataaatggtcacatcctgcttgctctgttgtttgtctactgctagagttaagaggaatgtgaattttctggtatgcttgtctccatcaaaactgagtaaacaaaatataaacca

SEQ ID NO: 260119 - DNA, 826 bp, Homo sapiens
tatggttacaaatgactctgaatgttcttgtgactaaatctgtgtgtgctttcttaatgtaacactaccactgctgtcattactattggctacagtgccaggcattgtaccaagtacttatgagcgttgtctcatttactccttaatcctgtgtggtagctaatgttaggaaataatataggtaaagatcctgttttgcagaattaactggggctaagagattttaggtgacttgctacactactagtgagtagtggagccagcatttaaactttaggagagtgacttcagagcttgaatatataactagtatatttattacctctcatgttgttctttttgtacaaaaaagctcttctcccatcttaaaaacactaaagtcttacttccttcactggctactgcctaaaattttttgatcctgtttatagcaaaactcctccagagagttgaatgcattcgctattagcagtccttctcttcctcccattgtttcttactctgaccagacgttttcgcctaccactctactgtacccacgctcttatggtcaccaacagctaaatccagtgataaatttttaattttcagttctaatttttcttgacgtgttacttgacattgttttgtcacttcttcctttttgatatacttttttcacttgactttcgagggtccatattcttgatttttttcctttttgcagtaacgtgaccatagcacactgtagcctcgaactcctaagcttaaacaatccccctgcctcagtctcctgaatgactaggactacaagtgcataccaccatgcccagctaattaaaaaaaa

SEQ ID NO: 260120 - DNA, 609 bp, Homo sapiens
tatggttacaaatgactctgaatgttcttgtgactaaatctgtgtgtgctttcttaatgtaacactaccactgctgtcattactattggctacagtgccaggcattgtaccaagtacttatgagcgttgtctcatttactccttaatcctgtgtggtagctaatgttaggaaataatataggtaaagatcctgttttgcagaattaactggggctaagagattttaggtgacttgctacactactagtgagtagtggagccagcatttaaactttaggagagtgacttcagagcttgaatatataactagtatatttattacctctcatgttgttctttttgtacaaaaaagctcttctcccatcttaaaaacactaaagtcttacttccttcactggctactgcctaaaattttttgatcctgtttatagcaaaactcctccagagagttgaatgcattcgctattagcagtccttctcttcctcccattgtttcttactctgaccagacgttttcgcctaccactctactgtacccacgctcttatggtcaccaacagctaaatccagtgggtgcagttgggggttcctctacatcgtcctgcagcg

SEQ ID NO: 260121 - DNA, 437 bp, Homo sapiens
aatatttaccgtgtgtcagacactgtgataagtatttattgaaacgatctgctttgattcttctaggatgtttgtgctcaatactttatgtggattatccaatttaattcttagaccatgaagtaggagctattctattattcacattacagtagaagaaacagaggcacattttgtcccagttcacctagcctagttagtgacagagctagagtgaaacccaggcagtcttgatttcagtaagcactcctatatgcaccatgctatcctgtctcttcctaggcactgggaattgctttccatactttcactttactttcttgtattttgtttttaattttagaattggtggagtgttctggttattgaagtaactttaacgaatttgtaatataaaatgttggtaaataatcataaagtattcaagaataaatgtc

SEQ ID NO: 260122 - DNA, 237 bp, Homo sapiens
cttttcaccaaactggagtgagggcttgtgctaggttttggactctgatctgcctttgaagactcttccaaatgcaaagacttcatgttccttgtttattatggaaaaataaacaatgaaggtttgtataatattgagtatgtagtcaatgtataatatgggtaaacaaaaaatgtatgcacagaattatgaacaaagtcataaaaaatcaacaattaaaataaaagctataaaatg

SEQ ID NO: 260123 - DNA, 118 bp, Homo sapiens
tgagtgcaaaagccaatgcaatgacaaaagagaagggtggaaagaactgagtccctggtggtgtatttgagctactgaatcaaccaacgctgtgagggccttactggtagactctaaa

SEQ ID NO: 260124 - DNA, 550 bp, Homo sapiens
acacttgaagaggatcaatccatgtcatcatgtccccaatttcatagcaccaagtattttgtttattcacaaatgccctattatggacatctagcaaacaatgatacatcagaaaaggagatgtgcataaattttcatggaataaggttgtggaaaatgcactagaatcaacaaacatggggactaattcaactcggatatcatgtcttcagagaagtttctcctgccctcctctccctgtagaattaagtattcttccactgtgccaccctctaacttgtgctcatatcttcctctattgtagttatgtgttcacatccctgttgtttttgtaccggcttctcccaaagggagacatttagtcttattcttcttggtaactttagcacagacctggcagattgttgacactcaacaaatgtttattgactcaaatgcattcagttgaacattgacctttgatcaactctgggaaaagtctgcaaagctagttaggacattcagaaattcatttcatttcaatcctaactaaataaattattgaagtctc

SEQ ID NO: 260125 - DNA, 612 bp, Homo sapiens
cctccccagcgtgtctacaggtatcacgtcccaggcccccaggaggtaaggaggagggtgagagctcctcacatctgtggctccgtggaagaggacgcgtcctgtgcctccacaccacacccttgacattggctgttgtgatgctctgggtataatcagtcccagctccaactctttccatggcactgaagcctggataacacagtagatggggtctcagtctgtggcccaggctgcagtgaagtggaaggaggaaaagaatgggacctatttcacctggagtgtcgcatccaccaatatcaatgctgctgaaatgaaggagattctctctctctctttctctctagaggtggggtctctgtggcccaggctgtagtgcagtggggccatcatggctcactgtaggcttggccccaagcctgaagcaatcctcccatctcagcctcccaaataggcctgactgcagatgcttaccaccacacctggctaaattttctatttttattattttattttattttttgagatggattattgctctgtcgcccaagatcatgccattgcactccagcctgggcaacaatagtgaaactccatctcaaaaacaaaaaa

SEQ ID NO: 260126 - DNA, 391 bp, Homo sapiens
gcttgcctttttctaggtccctacattgaattgaggcaaagattcaaagtcaaagggcatgttgtcacaggaatagggcacactcgtgacaagagtgggaggatggtggtaaaggagcttatcaaaatctcagaagagagcacagagcctggaagttgtgtggattcaagggagcagtccttatcctaaatgtgtactcaggttccagaaaagcagagaaaagtgcagtatctcagctctggaactcagatacagtgagaagacagtcaaagagaattcgcccacattatatttgaacaaacagaacattttcaaagagcaacacgtgttaaataggaataagacagaaagaagcagcatatccactgtctaaaaccaagactttcataaa

SEQ ID NO: 260127 - DNA, 714 bp, Homo sapiens
aagagattctacagactcagctgcaacaattgccagggctcctggtctgggatccagtggggttctgctgggaggctgctgaattctgttcatggtcactgaaagggcaccctggtggcctggcggcaggactgggcttctgcctacactcaagcccaggtgcttcctgccactctgcccagtgagactgccttgatccacagctgcggtaggagacgaggaccgtgactgtctccttccagtctggggtaccaggcagggcccagacaggagaccaggacccaggttcagcaggggaaatggttggaaatgttgaaaaggcatctgggggtggggaggccaaccagagaggagcagcagcaggaaactgtcacccctccgcccccctaccagtggggttgctcccagggctggagaaacaaagggagggagcccagaacctggactgcccaagggagctggagccatgaagcagatggactcacagccagagctgccacccagatctggagatcaggaggaatacccagacttctcttcttcctctgccctccatcttcctccagaacctttcattgggtctaatcagaagccagttggcaagagggtctggagcatgtgatttgccctccaagatactgagcagaacacaggcaaggaacagatgtgacacaccaaacaaatgaccaggacacagacctctccagggctgcc

SEQ ID NO: 260128 - DNA, 671 bp, Homo sapiens
gaagggtggctcacttgaggtcaggagtttgagacccacctggctaacacggagaaaccccgtctctgccaaaaatacaaaaattagctgggcgtggtcgtgcacttctgtaatcccagccactcaggaggctgaggcatgtgaattgctgaacctgggagcggaggttgcagtaagctgaggtcgcgccactgcactccaggctgggtgacagagctagactctgtctccaaaaaataaaaacagaaatgaatgtgtgttaaagtgtggaccactgaccatgtctaaccaagtcaccaataggatttgttaaacatggatattctcacacttcagaactcttgaatccaaatcctcatgggtagggatggttgttcatgagaaatctcttattttgtggcatttcaatggccagaagctgcactggggagcttagtaaagctgtaggacttgttagtccccatcctggtgacctggctacttctttattgtgcactgaagtatgccacaggtgattggataagctttgggactgtattagttttctatttgctgctgtaacaagtcaccacaagtgtagtggcttgaacaacataagtttatcatcttatgattctgtatttcagaagtccatcatgggtgtcaccgggtcaaaatcaaggtgttggcag

SEQ ID NO: 260129 - DNA, 917 bp, Homo sapiens
gagagacagagttttgccatgtcacccaggctggtctcaaattcctggactcaagtgatctgctcacctcagccttcccaagtgctaggattacaggtgtgagccaccacaccgagtcgattttttacatctatgtactttctaagatctgagcattaaaatggataagtcagttcaggagaaagacattaatctaaataagtaactatttcctaaatgttagcaatttccttcatgtcaaaaggtcgtaagcttcaaacacataaagcaaaacatgtcaattcttgattatgactataaactgcaattaaattatccagccatcagcttgtaaatatttacttagttgatttgatccttaaatgttttataaataaatcacaataaatccaatgttacaagatttgattcagacaccttacagatttctagaacctaagtaaaatactatataacctttaaacaccagtccttgggtttactcaaaaacagtatttctcaaccattttttaacccacaatcttttatataaatataaaaattttaccctactgagagattcagagtccctaaggtggctgtcctgcatagagaatcatatattctaattagccccagtagccaagaaaatgctgtctaccttaactttctgaagtctgtaattctttttatttcaggtgggatatggctttacaaaacatactctcaataacaaagatataacatttcccaagagtgaacactttgggagtggttatttgtctaaaatactcaatttttaaaaatgctacactttctgcctctacaaatagtcacagcaataaaattacaaagaaatacaagaaaacatatttaatcaaccccactattactcttaagtcttcacagtcaaagccttattatatctctttaaaagt

SEQ ID NO: 260130 - DNA, 511 bp, Homo sapiens
gtctatgggtgttcttcctttggctttccagtggggcctgtggattgactagtttaaagaaaacaagtgtgaacaggggaacatttacatggctctagttttacatgactctagtgttgaccattggattttctcgtggtcagcagctgtgggggtgtgttgggttttgagtcagtgagatgagaaacaagtatactgtattgcagacaaccgcatgggggagagagaagttttaactaggccaaaggtggtgggatacaactaggtttcaagcaacttatgtcaggcctaaaaataaatgctgaagcaacaactatataacaaatttatacaagtggtattgaaggtgagagtaaagcagggtcttctgcttttagctccttattctttctacctgactctactttctttatacaatactagaagaatcaaggtctaaaaaataaatctagtatgaaggacctgagttgctttcttagccttgaattagtttggatcttactatttattt

SEQ ID NO: 260131 - DNA, 806 bp, Homo sapiens
agatgtttggggctatgtcgtagatatagtataggcataggaatcctaaggagcaggacatatttcagcctgaatatgacaaaaatcccacttattactctcctgagagcttcaagtgcctatatgacccaaaatacaatggaaagcctattggcgaaagtcatgggttgattgatctaaccctgagataaaatacttattaaaatattatcttttaatgggtttcagacaactgaggctaagccctttaattactttaaggaccatgctcactgaagcttttaaaaggtattttcaaaagcttaattgcccaagaaaataatcagtgtaagagtattaggttacccagcagaaaatgatgtcttctacatacccgtctacatcacaagaagggaggggtaaaaaaggatcaagatcttattcttctgtaagcctacatgtgcatgagtgttatgattttgagactactcttatatacatgtaatttgatcctcttatcaaaacaatatagagaataactgagcccaatctttttagtcatctcttcaacaaggggtaaatcagtcagtttctaaaactggtgggaggtctccataaacctgataacaagatcccaaaatccaaactgattgactgagttaattcctgatcatttgggttgaacttaagagttatacaagaaaatggtaggggacgaggaggttgtataaaggggaaaaaacaacaactgcaaaaagcccaagagcctgaatttagaccaatctatcatcttcctcctcttaaaaagaaaacaatttaaaagtttc

SEQ ID NO: 260132 - DNA, 343 bp, Homo sapiens
gcattttctaaatatatgacgtgtcttctgtaaacagagatagttttacgtttttctttccaatttggatgcctcttatttcctttttttaaatttttgtgggtacataatagatatatatattcatgaggtatatgagatacaggcatataatgcataattatcacatcagggtaaatgtggtatccatcatttcaggcatttatcctcttggcattacaaaaaatccaattatacactttcaatgtttaaaaatgtacaataaattattattgacagtagtcaccctgttgtgctaccaaacactagctcttattcattctatctatagttttgtacccat

SEQ ID NO: 260133 - DNA, 174 bp, Homo sapiens
aaccattctccccacactgatggcctttacagtgagcccttaattctcttctgctgactcactgagcattttaagaacccacgtgcagatgttcaatattcatgtctgtttgcatattttttatgtagcagctaaaagtctttattcattttactgcctgatttgaaataaaaa

SEQ ID NO: 260134 - DNA, 436 bp, Homo sapiens
ctatgagccttataaagactcatttagttatcttcacccttccttcttgggccagctcttcagggctctactcccaaggtgtagggtacttcccaagacttctgcccctggcaggctccagaccacagctctttctctctggctcaaggggttttttaaactgcaactctgtctttcagttgccctttgaagatctgcaaatgttccccaggacaaaaggagccttaaatatgaggctcactctcctgatttgtgtcttctcccagatcttggccaataaatccttatgacccttttgctcttcttgattttaaaacttaattatctattgcatctagcttttactagttatcatgaacaagagatctggtccgaattacctagtcctccattgccaaaaatgaaactcctatatggagacaacaacttttaaaac

SEQ ID NO: 260135 - DNA, 708 bp, Homo sapiens
caatgattttacacgtcctcttttcattagaagctaggctaaaaatagggaagaacaaagacatgtattgtatgatttatgtcggaatgtcttttattcttatatttttggttttgtgtcaaattcaggtgaaagaatgtcaaatgcctgtgtgtgtgttggcatctgaacttggcaaagaaggtgattgggtttggtagggctttattccagctttttcaagaattcctcacttttcaatactgaacagaacaggccattctgataaagaatccattacatacgtagaaaaattcaggctcatgaagaagctggggccagatttgtctgattcatgaaggttcttcagtttctagcagtttgtccttggagaagttatttaacctctctgagtctcgacctgctcacctataaaatggaggtaataagaggacattcctcataaggtctgattattatgtgtaaagtgcttaatatagtgtaggcaaattataagcacacatcaaatattagctcttatttttattacttatagacacataaatggacatgttaagaaaatatgattacttcttatcaatgtttgaaaattttacaatccaatcaacaaatgaattactcagtcttcaaactatgttgtctaattttattttgttattggtttctttaactttcttcttttgaggtgcaatatttttaaagctttta

SEQ ID NO: 260136 - DNA, 491 bp, Homo sapiens
tggagagggagcgcagctctggagacggcccccagggcttgcgggcgggcgggcgaggcagcgtggagagcggagagcgaagctctggagacgacccccagaggagattggccaagtgcggatgtgcgagtcctccctgcccgaggcgcaaactgtctcactccaaagggcgtccggagggttctgcggggcggctgtgcactgacacctgccccccacgtgggagtccgccggctcctggcccttgccggttggtgttgcgggtctgagatgacgcccccgcggtaggagcggggtttccctgatcaccgcttcttttgaccatcttttctggcagggccttgtatttttaaaatgtgtaaaggttaagctttctgagatcagaaaaataatatttagtgaaccatgtgatttaagtcactgtgtatgtgacatgaaatatttatacctaacccactagcaaatggctcgttaaacatatttgagattta

SEQ ID NO: 260137 - DNA, 166 bp, Homo sapiens
ctgaattcctaacatttctagttacatttctaattacattgatttcatgttaaatccacttatgtcagaatatattctgtataatatctgtctcttgaagtttgatgatacttgctttatggcataataaagatgcacttgaaaagtgtgtttatgcagttattgg

SEQ ID NO: 260138 - DNA, 382 bp, Homo sapiens
ggaggttgcggtgagctgagatggcaccactgtactccaggctgggcaacaagagtgaaactacctctcaataacaaacaaacaacaaaatgaaaaacaaaacagaacaaaaaaagaaagaaaccaaacccccccccccaaaatacatggtaggcactcagtaaatgtttgaatgtttgcagggtgttgaatgaatgagtgaatcattggtgattgtttctctctgaaaaataaatgaagaatgttttcatttgggcttgtatgtttcctctacattcagtgatgactgaaagagccaattaacttttaaagttgggctaaacaacctaggcctgtgactagaaagggctagatttggtttgtttaggagacaaaattgagg

SEQ ID NO: 260139 - DNA, 105 bp, Homo sapiens
gcaacagaaagttctaacgaggacccaggtttttagacagctagagtctccgtgtttcttctgattgtggtaggaaataaagccaggaaaaataagtctttataa

SEQ ID NO: 260140 - DNA, 166 bp, Homo sapiens
cacctgtgagcagtttatttaaaaagtacttaaaatatcaccagtaacttacccatttgaagcactcttggaattttgaatttacagtcagtccagtgggaaatgagtttcatgagctgatagaagttaccctcctttgctgaactatgaagagaggcatatttgt

SEQ ID NO: 260141 - DNA, 579 bp, Homo sapiens
gaaatcaatagatgtctacgattaatagaggaaattgtggaatagtcagatgcttgaaactttaatgagcagaaattttaaaaacacaatacagaaataatggtcttgcaacattaaagaggaaggacattgactctttggaaattgaccatggactcaagagtatgcagagtatcagagaaatttctacttaaaagttgtagagctggaggttccttataggggatttagatttcagtgaagagtttgatagaagtatttttcgtggtttaattaggcagaaggagctatatatgcagttaccacaggttgagcttccctaatctaaaaatccaaaacctgagatgctgcagaatctgaaactttctgagggctgacattatgccacaagtggaaaattctacacgtaagtacttaacacacactttgtttcatgcacaagatcattgaaaatattgtataacattcccttcagactgtgtgtataatgtatatgtgaaacataaatgaatttcctgtttacttgggtctcatccccaagatatgtgattgtgcacatgcaaatatttcaaaatctta

SEQ ID NO: 260142 - DNA, 134 bp, Homo sapiens
ggtacatgcctgtagtcccagctactcacgagtttgaggtggaagaatccgttgaactcaagaggttgaggctacagtgagacatgattgaaccactgcactgcaagctgagtgacagaacaagaccctgtttc

SEQ ID NO: 260143 - DNA, 446 bp, Homo sapiens
cttcagcagccatcttatggccatgaaatggcaagcatgagaatgaaagaaaatgcactcatcatgaaaggaggaagagcagaagaaatctgggtcactggtgatatcaatggatagctgaagcagtgctgctctggatggaaaatgccctgggttctccgagacttaacaccccgccttgtgaacgcgagcaagattattctctctgagcagctcttttcacatgtgataagcttggcaagttgccctggattgaattctcacccactgtcttcacccaacccagcagagaagaaggcttgtgactgtgtaaggtgaaaatggatataccatttctgggaagagaaaagaagccaattaaaagtggggcatgtcattacactgaccagaaatgaacgtacctttttagaaataaagaatctgtatattcctgtggctctgattta

SEQ ID NO: 260144 - DNA, 1033 bp, Homo sapiens
ggccctgtctctacaaaaagttttttagaattagctggacatagtgtcgtgtgcctatggtaccagctactgggcagctgacgtgggaggatggcctgggactgggaactcgagggtgcagtgagctgtgtttgcacctctgtactctcgcctgggtgacagagtgagactccgtctcaaaaaaaaccccaaaaaaccaaaaaacattaattccatctgcaaagtctcttttgctaggtcatttaacatacacaggcattaatactagggattagggcatggaaatctttggggcctatttttagtctacaacaaagtattttatcaagaaaaataattcccacttgagaaagattattggaagtcagctgtattagtcattttattatggcagtaaaataaatctgtgctagtttatattttttaagtaaattattcactctttgatactttgatactttgttgagctgtgtaaaattgctaatatttgattgtttccaactacaaaacaacagcaatttcctatagtttaacctagtaccagtaagttaaaacatacctcatgttaattacatctcacaattgatggagatatagctattttaacagattaaagagctaatgttctaggatgaagaattttttttttttttaaatcaagttctggctctatcacccaggctgtagtgcagtggcacaatctgggctcactgcaacctccacctcgtgggcttaagccatcctcccacctcagcctccctagtagctggactacaggggtgtgtgaccacacccagcttatttttgtattttttgtagagatagggttttgccgtgttgcccaggctggtctcaaactagtgagctcaagtgatcctcctgccttgacaaggtgctataattacaggtgtgagccatcatgcctggcccaaagaattttttcttcaaaaagttttgtatttaattggaaaataccttaataaaaagcattttcaaatcataagcagatgattataagcataatctttccaat

SEQ ID NO: 260145 - DNA, 815 bp, Homo sapiens
cccagccagcagaagaggatccgcagatgcccgcaggaaggggacgcattgccaggtccaccagctctcccacagacagctccaggcctcactgctgagtctgtgtcctatatacaatgtcatctgagggtggcaccgaacacctggctggcttgctggccacccaccaccctttcagccaccctggctgccctctggtttctatcgcgtctgttaaaaggcagacccctctggatgctttcctccactctttcaaagtgcccccaccctcacccttcaaacatcaagttgatggttgtaccatgagccacaggaacaataaacagcccggaagccactccactcaaggtctcgaggccctcccgacagccggccgcctgccctgccacggaggctgggcagcacagctgggggcttgagagctggttcaaatcctgtgtctgccccctgcgagctatgtttgctcaggcaagtagcttgccctctctggatctagtttccctgtcctcaaaagcatgggcagacatgggcaaagtgctggcttgcaattctcaataaattacagattatcagatcgctatttaactcaggcaacaaaaggaaaatacttgattgtgtggagagcaataactcttaaaaatggggtggccgccccataataagaaaagctagaaaaaaataaaccacagacgcagtgatttggcagggtgatatacggaggaaattctgccatcaggaaacagtattgtccataggttttcttcctactttcttcctttaattactaaataaaatcttcaatcactgaaaaatca

SEQ ID NO: 260146 - DNA, 4868 bp, Homo sapiens
atggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggaccctcggggctgcccctgctgcctgtgctgttcgctcttggggggcttctgctcctctccaatgcctcctgtgtcgggggggtcctctggcagcggagactcaggcgtcttgctgagggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagttttcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgattttaaaaacagg

SEQ ID NO: 260147 - DNA, 4924 bp, Homo sapiens
  misc_feature (4354)..(4354): n is a, c, g, or t
atggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggaccctcggggctgcccctgctgcctgtgctgttcgctcttggggggcttctgctcctctccaatgcctcctgtgtcgggggggtcctctggcagcggagactcaggcgtcttgctgagggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagtttntcatatgtctttccccacttctgaaaactttacttcatgaagcacttagggaccctcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgattttaaaaacagg

SEQ ID NO: 260148 - DNA, 4748 bp, Homo sapiens
atggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctcaaaaaataaaaataaaataaaaataaaaaataaaatgctattctgagggtccctaagtgcttcatgaagtaaagttttcagaagtggggaaagacatatgaaaaactctgttcattttgcattccatgacgtctgaaatagctaataataagtggaatttatgaatccatgttgcatcctacctattattttattatttccgacagttatctaacacaggaggcataaactatgacacatgtaaacataagtatgctccataagcattaaaataaacagacaatcaaaagaagctagaggaaaagaatatgtactgtgtgtgtgctttcgtttatagaaattctaaaataggcaaaactaatctacggtggcagagagcacagcagaggtttcctggggccatgagaggagggttgactgcaaaaaggcatgggagaactttctgaggtgttggaaatattctatataacgattgtggtggtggttgcacgggtgcacagatttgtcaaaactcattgaactttacacttaagatgggtgcatttttattgtacataaatgatatctcaataaaagtgattttaaaaacagg

SEQ ID NO: 260149 - DNA, 353 bp, Homo sapiens
ggctgtgtgacgccgtgcatgtgattcccaccatgtgctggtaacacggatgagagatgctaccatttatgctggcgtggttcttggtttaggtgtgctggcccatgtcatcgtcctaagcaccccggctgcaggcaccagtctctgccttacagtcgtgttgatggaggtgtcagtagattatgtggcctgcccaggttcacatgggacctgcatagtagagcaaaagtcagtgccctgaggtgtggactcagtgtctccatcctctttggagtcacacaggtgaggactgcagtcccgactcaggtctggggtggcctgggcgaaggagcacacaccctgcagatgttggt

SEQ ID NO: 260150 - DNA, 163 bp, Homo sapiens
atggtaagtaaaaaacacctgttccttgtgacagttatgaatgcatgtcatatgtacaacattatgaattatctaatgtcactgaactgtacacttaaaatgattaagatggtcaactttatgtgtattttatcacaataaaaaaattgaagcaataaaaccc

SEQ ID NO: 260151 - DNA, 394 bp, Homo sapiens
gttgggcagaagaatgtcagttaattgtgagaagttggtgaagagggaaaagccaagggaattaatttttccatctaattatgacctccttcgccacttacagtatgcaacacattttcctatacctctggtattgatgtctgttcctccttctgtttgagagtcacctctgaggatcataaaaaattgagataagtgatgtaaacttccacatgtgttatatgttttgtttatgttaaaatagcgaatatgccttgtgtagaattagactgcatgttataagtctgacctgttttatcatttacatttgaacttattgaaatgagaagtcatcttcagaagagactttgcacaataacatgtaataaaggtgttggcattaattcttaaatgg

SEQ ID NO: 260152 - DNA, 434 bp, Homo sapiens
tgttagtttctttcactcatagttgtagtctttaggctggctaattctatatttaacttcaaatcttcctcaggattctcagaaccatatattcttgctattaaaatacattcctgctttttcttaaaccataaactcctaagagtattttctctatgacatttatcataatgatttattcatagctggtgttctataaatgtttgtttaaaatttagcatgcgtttgttaagtgcctgttatgtgcagtgcgtggagttaaacacagaaaacaaagtaaaggaagtggaaagacatattctagctatatggtaggaaaattttgctcacttttgaagagatgaagatatatttaataagatagattagaatttataaaaataaaaagacattggcgccctgaaatatataaaatgaatatggaaaggaaagga

SEQ ID NO: 260153 - DNA, 401 bp, Homo sapiens
gagcgagactccatcttaaaaaaaaaaaaaaaaaaaaaaagaatatagagaagccagggcaatcagattcattgaaggataagggatagaatataagtaggagaatcaaaagagaattgccagcagggcgtggtgactcaaacctgtaatcccagcactttgggagcccaaggtaagtcaattgcttgagctcaggaggttgagaccagcctgggcaacatggcgaaacactgtctctacaaaaaatttaaaaattagctgggcatggtggtgtacacctgtagtcccagttatttgggtggctgaagtgggaggattgcttgaacccaggaggcagaggcagcagtgagccatgattgcaccactgtactgcagcctgggaaaagaaggagactctgtct

SEQ ID NO: 260154 - DNA, 418 bp, Homo sapiens
gctactactactaaattcgcggcgggctgacgaagcaatagagattacacaagatcggagtaaaatgttcataattgttaaagctgggggataatcacatgggaatttattatactattgtgtctattcttatgtatgcctgaacgttttcataataaaaagtttcaggctgggcgcagtggctcacgcctgtaattccagccctttgagagtccaaggcaggaggattgcttgagcccaggaatttaaaaccagcctgggcagcatagtgagaccctgcctctacaaaaaaatttaaaaattagctgggtgggctgggtgtggcggctcatgcctgtagtcccagcacattggaagaccgaagctggtggatcacttgagctcacaagttcaagaccagcctaggcaacatgacgaa

SEQ ID NO: 260155 - DNA, 430 bp, Homo sapiens
ccccagcaggcacgagggctgcagcagtctggttccccatcccctcctcaggggcctgagaacaaattggtttttttttcaaacatggacagtttgtcttgtaggccacccacgtgcaggtcctctccatgctgtggacgcagccagttgtgaagcacaatccctccgtgacttcgcttcccagcggtacctgcaatttaaagttatgtcccctgcctactctcaggggcacctcaaggggacaaggccctctagcatccccttctcggaggctgttacccaaggatggaaactcatgcttctcccatctctgtaatccatgcctgcaggcacagacttcaagttactgctgttatggttgagatttcaccaacatttggcattttcattttccaaaaataaaatgcattgactgcttttccaaactaca

SEQ ID NO: 260156 - DNA, 841 bp, Homo sapiens
tccccagaagatgtgccgtttgtcatagaagcactcacagcatttaagtgctaatcttcaaccgctgccttccctgacgcaccccggaaggcgtgttcttggcttgacacttctcagcccttccgcttcctacagtggctgtgacaccccgctaatcctcactggaaacatgtgctgcccccaccactcttctcactccagctctctttgtgaacacaccctctgtttcagaatcccacctccttgtcaccaaaatgtaccaaggaccattcctcttcgcgtcccttcctcccttctcaagaaaacccttctcctattaacaacaacaattaacagagtgccttaaaaggaaggcactgacctaagcgctttacatgcttttgttgttgttgttgttgttgttgttgttgttgttgttgttttgagatggagtttcactcttgttgcccaggctggagtgcaatggtgcaagtctcggtctcaccgcaacctccacctcctgggttcaagcgattctcccgcctcagcctcccaagtagctgggattacaggcatgcgccaccacgcctggctaattttgtgtttttagtagagatggggtttctccatgttggtcaggctggtctggaactctcgacctcaggtgatccgcccaccttagcctcccaaagtggtgggattacaggtgtgagccaccgtgatcggcctacatacattttatctaatcttcctatgacagtccttaggtaggcagaaatgaaaaaactgaggcacagaaacgcagcttggatgtggtaatgttgaaattcgaatctattgggtagctgactctaaatctggt

SEQ ID NO: 260157 - DNA, 508 bp, Homo sapiens
ctcatccacaactcgctcaggactttctagccccttgtgtggtaacaggttcctgaggactacggcataatcagatctgcaagctgcctttgtttccatcctgagtgaagggctcagataagtggctttgtgtagccctgggatgttttcatacagatgacagagttctcgacagatctggcctcttgtccatgttgttgagattggccgattcacttagatggtgtagagtggcttttggattgaaggttggctcctagggtagaaatagcaaatgcatacatgtttgcagacatccctgccagtgccccaagcttcagagactggctgcaaggttccctgggttgaaatgaaagacttttttttttttttaggtgcccaatagagaactgaaaattggagggaaacagaaaggtaggcatgaaggagaattgtttttccccatcagaaacaaagtgctttgggaaaaagtaaataggtgtcaatagttaacagcttaaatttaaaa

SEQ ID NO: 260158 - DNA, 385 bp, Homo sapiens
tccttgggggtttatatcaacattggtcttgacatttcgcctgttattatgtgtggctctttagagggtgaaataatattttcttttgcttgagaaaaggacaaagttcagacagagctcttggccccaaatggattttcctccttctctgctttccatgtgccatagctacttggagttccggagagccatttctgtggagcggacatcctctcagggccatgggtgcgatccggggctgcagacagccaccgtgtgctgtagacacaacctgcactccacaggttcactccgtcctctaaacaccatctgcttcccaaggatgaggtgaaatttcacttgtccaggatatacagccatggtaagggggtctaggattcatgct

SEQ ID NO: 260159 - DNA, 514 bp, Homo sapiens
ctggtgcccctggagcagaagtcctgatgtggtgatatcatttctatgccttcgaatagaaatgaaattcagagacacattttgaattactgtgaatctgataataaactttcatagcattgtctaacttaagtgactcaacaactgccttgtgaagtgggaaaggcaggcataagcctctccattttgaggaggaggaagctgagaactgaaaaagtttaaatgactttttgaatgccatagattgcataaatgtcaatattgggactcaaattcacatcttcagatttcaaatctggtgtgtcttttgttctaaccacgttgaacctgaagaagaaaagaccaaagcaaatacataatcaaatgggttatattctgagattacagtaagaaggggcaggagattaaagtgagattgacaaaattaaaaatattcagagggtattttttgctgtctaatgtgctttttttttgctgagtaatgatacatttaaaaccttaatgctcatttatt

SEQ ID NO: 260160 - DNA, 400 bp, Homo sapiens
aaggaaaagtaaaaagaaaactgaaactggggagcaagtgtgcagcgcagagacgagcgtgcctcccacagggtccctcgcactgagatagcaagtggacatcaaggcgaggcaggaggggccgggtggttttggtgctggaatgagagaggagagccctgggcctgggtgtgtctggctcagaagctgtttccgattttctcagcattcctctttcttcctgggccctgcccttcctcagatggggaatgcagcctcacctgccattgccctttgcctgcttccatggtgagcacagtcaacaaagcccaagcaactcagtggggatgccaatcacagggaggcgagtccaactccctacagagccaggccacccccatcccggccttcagggcttgga

SEQ ID NO: 260161 - DNA, 360 bp, Homo sapiens
ttctttctttcctctgttactattgcacatttcctttgctagagagccaagtcagaaactcttctgataaagttaggtatgccataactatgacattctctacaaaaaacatttttgtgcaagatctaaatattaaaagttttttgcagtggaaggccagaggctgtataagcacactaaagtttggctttttatccacttggatgttctctaaagacatagtttggaatgttgtaagattagctccattggtggaacatatgtaacaagttcctttatctttgtatacagctttttaaataccatatctgtctattataccaactggttaattttggttaatttatttaaacatggaaa

SEQ ID NO: 260162 - DNA, 418 bp, Homo sapiens
ctcctttgcaaattgttttgtgatttttttggcagaattaatgccaactgaaatttttatgagttcactatcaattctgtgaattattttagtttcttagtatttttttctggtatcaaatttttaggcattttagtgcatcattgttttaaaaataccaataaatgatagttatcatgtgctgttttgagcactatctgccaagctctgtactaagtggtttatattcattattttacttaatccataaagcaagccaagtggtaggtattattgttcccattttacagaatagaaagctgagtctcagtaggattaagtaactttccctaggttaagcattaagtaaacctaagagccaggatttgtgataaggtctttttgattcccactgtaccactggacctctgtagagaca

SEQ ID NO: 260163 - DNA, 466 bp, Homo sapiens
caataaatgtgaaaacctagatgaaacctggggcaaagcctgccgtgtattcccaaatgatttcccttccttctgggcacacagccctgttacacttcccattctcccatggattcatctgcagccaggtgcctaagttctggctaatgaaatgtgggtggcagttaagttcaccacctccaggcccagcctgtaaaagctaaccccgcagcgcccccatgctgtccgcagggaagaatgctggatacagaagcgccagtggaggactctgagctcttaatgctcccacaagatgggagagttctggctctcagagcccttccccagcccacgacggacaatgtcaagagcgggaaataaacttcattgtgttaagccactgatatttttgggtttgattggtatatcaattacctccctaatgtaaaatggatatgtttcttaaaaaaacaccagtattgttgca

SEQ ID NO: 260164 - DNA, 451 bp, Homo sapiens
tcctcagttataaaatgtagataatgattctctgtaggtaccaccaggctgtcaagagggtcaaatgaaatgatcagtatataagttctttcaaaagtaccaaaaacgtatcttgaaaggactatttgtaatctcattctcagtgctcacttccacacattccttcttttgaaagattaagaaaattaatccaacacaaccccctagtttccctttgttcaccccactccagccagcctgtccttctttttagttcctcatatgtgctatctccatcatgatattttcagttcaaggaataaaaattcccatgtcaaacagcttcaatgacaggacattttattttcccataataaggcatccatagatagagtgggtcccaggtaaagaatgtcaggcccatccctccacatcttttgggtctgacctcccctaagggtcactctcatcc

SEQ ID NO: 260165 - DNA, 341 bp, Homo sapiens
cggcacgaggctttcttttttaagacagggtctggctctgtcacccaggctggggtgacaagagtgagactccatctcaaagaaaaaaaaacaaccctgcaggaatgccacagccaccaccgggctccttgacttggcagaggctacggcctcacccaactccaaaagcaccgcaatggataatgctggcttaaagagtaatgggtaatttttctttctattttgaatactttgtgtttttctagggtttctagaagtgttcatgttatttgttagaaaataattttcaaaaagcctttatcctttcagaaaaagcagataaataaaaacgtttttgaggg

SEQ ID NO: 260166 - DNA, 847 bp, Homo sapiens
gtctgctcacctgaggagctccctgggtctgccagcttcctgcctggccaagcccttcccctgcacttgtaagacgacgactgagcgtggctgatcctgcccggtttctgggtggatagtggaacctgggggaaccagggtagaatcccttatgggaggcagccattggcctggccaggctttgggcgctgttggagacagggctgaatttttagccctgagtgtaggcacaggcgagagctggagcccaggcacttgttccctgtgtggctggctgctcatctctgatttagctttggctcaatttttgtcctaccccctgattgctactggagccagcatggtggtcacagccactggtgtcttagggccctggaagagaagacagcaatcccaggttgccctctcctctgctcagggctgatcctggcagacatggaggaggagataggcaggaggagatagggagaagacttgggagggagctgggtcttcatgccaaatgcaggaagaaacaagccatcgttcagttcatgtttgagctgcgtcagcccatgtgaaggcccccacacctctgggaagaactgcagggagcatctctctggtccccgtctccaaggtcggggaagcattttacagttttggaggtgatgcggggaagggccacagccaaaacttcatgtggcagtctagcatgccacacctcactggaatcccgcacgctagaagggagccgccttgtgagaggtgttccagtgaagtggaaccccaccagtaggtggtgggatgggctccagaacagtgtctggaacaggaactagtagagctcaacgtcttagattcctta

SEQ ID NO: 260167 - DNA, 631 bp, Homo sapiens
  misc_feature (383)..(383): n is a, c, g, or t
  misc_feature (396)..(396): n is a, c, g, or t
  misc_feature (414)..(414): n is a, c, g, or t
  misc_feature (513)..(513): n is a, c, g, or t
  misc_feature (538)..(538): n is a, c, g, or t
  misc_feature (555)..(555): n is a, c, g, or t
  misc_feature (558)..(558): n is a, c, g, or t
  misc_feature (561)..(561): n is a, c, g, or t
  misc_feature (568)..(568): n is a, c, g, or t
  misc_feature (572)..(572): n is a, c, g, or t
  misc_feature (582)..(582): n is a, c, g, or t
  misc_feature (585)..(585): n is a, c, g, or t
  misc_feature (600)..(600): n is a, c, g, or t
  misc_feature (606)..(606): n is a, c, g, or t
  misc_feature (614)..(614): n is a, c, g, or t
  misc_feature (619)..(619): n is a, c, g, or t
gggagagaactagttgacattttaaaatataggtctgaaacctacaggaaaatattggagtaaaaggagcacaggaaaagtgtgcagagcattgttacccaaagtgctgtaggaattttatacacatatgaatacaactcgcaaaacacacaaatatttttgcttccctggatcatttactggagtcttttacatacacattctgaagtataaggtatgcagaattttctaagcgtatcatagaattccattccaagaatacatttcaggaaaactattgtcaatcagggaaacattggtgcagaatagtaagaaaagaaatacccattaagactagtacttacggaggaggaggagccaagatggccgaataggaacagctncggtctacagctnccagcgtgagcgacgcanaagacgggtgatttctgcatttccatctgaggtaccgggttcatctcactagggagtgccagacagtgggcgcaggccagtgtgtgtgcgcaccgtgcncgagctgaagcaggcgaggcattgnctaacctgggaagccanggngtnagggagntccntttcgagtcnaangtgtgacggacgcanctggtnggtcactncccgnattgcgcttttt

SEQ ID NO: 260168 - DNA, 448 bp, Homo sapiens
gggagagaactagttgacattttaaaatataggtctgaaacctacaggaaaatattggagtaaaaggagcacaggaaaagtgtgcagagcattgttacccaaagtgctgtaggaattttatacacatatgaatacaactcgcaaaacacacaaatatttttgcttccctggatcatttactggagtcttttacatacacattctgaagtataaggtatgcagaattttctaagcgtatcatagaattccattccaagaatacatttcaggaaaactattgtcaatcagggaaacattggtgcagaatagtaagaaaagaaatacccattaagactagtacttacacagtggacgtgaaaaaactaggcagcaaggagttattaaaaagaaagcatgggctgggcattgtggctcatgccagacacaccgtaattccgcctgggtattt

SEQ ID NO: 260169 - DNA, 367 bp, Homo sapiens
gaatagtaagaaaagaaatacccattaagactagtacttacacagtggacgtgaaaaaactaggcagcaaggagttattaaaaagaaagcatgggctgggcattgtggctcatgcctataatcccagcactttgggaggccgaggcgggcggatcacctgaggtgagaccagcctgaccaacatgaagaaaccccacctctactaaaaatacaaaattagctgggcatggtggcacatgcttgtaatcgcagctactcgggaggctgaggcaggagagtctcttgaacctgggaggcggaggttgcagtgagctgagatcacactgttgcactccagcctgggtgaaaagagggaaacttcgtctca

SEQ ID NO: 260170 - DNA, 453 bp, Homo sapiens
ttaaaaaaaaaatctatcccaatccacttcacattcataaatctataatgaaaatattccttagtatttttttcacgtcaattctgcagttccagttagacctccctaggtctcatgttattgaatgtgatttggcatgggttttatagcctctcaacttactctggttaacactcaaataatcactaagcttagtcaaatgaaatccctgatgtatatgtaagactttgaaattagttatttaaacctttcataatctaatccatgccagtggattaacctggactagctgttaagggttgtcttgcaccaattatgcctgtttgtattttattggcctatgttgataagagaatatgtcatgtaattttaaaagaactaagaataatattttaggatttgacatactgcatttaaagtgggacccattgaataaacatgattaactcacac

SEQ ID NO: 260171 - DNA, 321 bp, Homo sapiens
tgaaacaatgtttttcataatgacggtagattgaagtagattttattctcctccatccttgctttatctactctgttctgtgtgggggtaacatacaggtccttttgctttcttcggggatgacacagccacctggccaaaactgatcaaacccctgcttctgtgggaggaagacccccaagaaccatcagagaccaaaggcaggtggatgagaatgttgggtggggacttgggaggccccaaatggtgatgtgttgatgagggcaacctgcctgccagtcatcctttagggactcagaggaccacaggagaagggagggt

SEQ ID NO: 260172 - DNA, 352 bp, Homo sapiens
gccagtatcaagacttttgtattctgtaaaatatattctctcctttgatgctaggttaatgaaaacaccaggattcttaagtaggggaaaaacatacacacatttatatgatgttgatgtgtcattaccaaataaaagcacacatattttcatttaattttaatatgtcattgcttaatgaaatacatgtttatatctttaaagaggtatttatcagccactcagagtttactaaacttaaagatgttcagactctggattagctaatttctctttgttactaagaggttgattatccttagtcagcatcctgaatcctatccctctccaattctgcaactcaataaaagaa

SEQ ID NO: 260173 - DNA, 392 bp, Homo sapiens
gtttcccatgtaatgtcaccaaattttttccattctgagaatccttcccgaggcactagcgcagttttaaaggcagaaaggggaccaatatttttatgacagttttttttccttggtctgaggttggagcataagaacgaaatagctctttttgttcattgtaccaagaaattccctcctggatctatcaagtgtgactgttcacatagcaaatagcttggacatatccagacataaacaccatatgaataaaacatgttgcaattgttggatatagttatgtgttttacaaagacaaggtgttctgttctacactatctgcagaagttcacagtaatcattctaaactgtgacactttatcttattaactgaataaaaatacttttaatta

SEQ ID NO: 260174 - DNA, 401 bp, Homo sapiens
ttattccagaccccacaggcaatgctaaattgttggaagaaatcgggagcacaacacagcatcccaaggctccttgctgcaaagtgttcaaaggcggctggcagtggcaatgggcttcacgaactacaatataaacacaattatcaaatcacagactgatcaaatgccagaaaccacacctcagataattccacctgcatacaaaatagagctattttatttcaaaatagagcataataaaacttaaaataattcaacatgaaacttaattttcttcatttctacataagaagcgagacaataccaaatcttcctgaagccagccagagaactgtgtgggtgtccagatgcagatatctggacacctaaacctgaaaggaaatgttgtcccctactctaat

SEQ ID NO: 260175 - DNA, 680 bp, Homo sapiens
cccttgaggctaaacgaaaggagacatatcagccattttgtcctcaggatctcttccagcccctgccttgttgatgagggtgttgcttgacttgaggccaggtgtgttaggaatgacacgtaggtgcttgcaggggattcggaggtaattgggaggtgaaaaaagaagtcaaaccagaatgcagccagataccagggagaacaccaactgactggcatgccaaagccttctgagcaggtcaccctggtttttgcagaattaagaatgatatcgctgtacacattaaagtattttaattggttgccaaggcgatacggcagaatcacagggcacagagcaggaatagaactctgcaggtctgtgttcaggaaaggtgttcgtctgtgatattaacgagctgcctggatatgagaaaggcaaagtggcagtaaatcttatctgggacttttgcttaataaacaggaatggcagagaaatggaggggcagaagagaaaacttcccttcccagctctctggagaagcaggagaggtaatcttctggattccaaatttctcctcagagtggtgaattcccacagctgagagaaagccgagtagattggtttgatgcataagggaaggaggaacagagggagagaacaatggaagaagacagcagtgttcttttcctattgagagg

SEQ ID NO: 260176 - DNA, 627 bp, Homo sapiens
cccttgaggctaaacgaaaggagacatatcagccattttgtcctcaggatctcttccagcccctgccttgttgatgagggtgttgcttgacttgaggccaggtgtgttaggaatgacacgtaggtgcttgcaggggattcggaggtaattgggaggtgaaaaaagaagtcaaaccagaatgcagccagataccagggagaacaccaactgactggcatgccaaagccttctgagcaggtcaccctggtttttgcagaattaagaatgatatcgctgtacacattaaagtattttaattggttgccaaggcgatacggcagaatcacagggcacagagcaggaatagaactctgcaggtctgtgttcaggaaaggtgttcgtctgtgatattaacgagctgcctggatatgagaaaggcaaagtggcagtaaatcttatctgggacttttgcttaataaacaggaatggcagagaaatggaggggcagaagagaaaacttcccttccagagtggtgaattcccacagctgagagaaagccgagtagattggtttgatgcataagggaaggaggaacagagggagagaacaatggaagaagacagcagtgttcttttcctattgagagg

SEQ ID NO: 260177 - DNA, 704 bp, Homo sapiens
gaagtttcccaaaggttacttttgcattagagaatttcgaaatacagattttaacttgtttctagtcctctttttttttatttaagacacaaaactacacagctttgatttttaggggaaaaggatgataactttggactatatctcacaaggtgacttttttttttctgttgtagttgatttctgagaattccagagtatcaggatgatgtagcaatttaaaaatagtaacacaaaattttatctctagtttttttcaaaaatctttttaaaactaaaatttgataagctagtactgagtagaatttggtgctcatcattcacacgtataaagtagatttcactcagaatttcacttacaccaacataacaattttacttttcctttttaaagcatagctataccttcagggatatgatggtatagtagggttattctctcaaagaagaaaaggcagtcagaaaatctttgttcatgagattagactgaaatcttcagtgattcagtgattactgaatgcctctatgtgccaggcactatggcaaaaatcagtgccaaagtaatttatctttatcatgtacaatgaggggttttagtgggttgtaacttaatatgatctaattgtgtgatgaggctactgagaaatctaatgcaatcttatgcttcattaatagaattagtattgtgtacagatctagggaag

SEQ ID NO: 260178 - DNA, 711 bp, Homo sapiens
gtttccccaaagtggaacctaagcagggtggcctgctgagttttatttaaaggggcaccttacagacacctcaagtgggaacccaaatatgggggcatgggtcagagtgtgaatgagtgtctgtgagtgtgagttgaactgagtgtgagaataccaacaggaggagaggagtggctaaaggtttaggggatagagtcaaatgtcagcgtaaatggtaggatcctggtcagagagcagctgaggaggcttcagggcaggggacccagatgggcagaaaggcgggtctggacctgcagctatgggacagtgtgcacaagtcaccaagtttaaatggaagggcgtcgggagattaagtgtaactttctacaaagcttcagaaaacaccatctatccaggaaaacacgtaggacacacagacacagttgctacacgcccagaatagctcctgccaacacatccctgtgttgtcacagggaaggtaacatcctcccaccccatccaccttgcagcttggcgggtgtgggaaagcacctcgctgggagagtgcaggatgctcccaggacccgccctggggtcacccgggtgcccagcttggcagaacaaggtccatgaggtgtggtggccatcacagacataagcacagggttgatggcgagggggcctgaacccaagactggctcacaccctcccccagcatctcctgcacagggc

SEQ ID NO: 260179 - DNA, 557 bp, Homo sapiens
cagagaatgcttaataaatgttaattgctgtctgactcctctgaatgtggtgtgtgaactgatacctttggatcctcatgcctcattctgtccctgagacttattctagatgtcacttcccctacttcacattatacacgaatgttctgaggacatttgagatggaatctagctcacattttcagcactagtttccaaggaacacaaagaagtccagtgacatgatccaggctctcagccttacagatcatcatgtagattaagtggccgaggctctttcctatgcagaaaccttcctacaaccaaggtaccccttgttattattgtcttcctgcaactttcataattgataagggaattagacaggtaagctaagctaggtattctcatttataatttttcaaagccacaagaataaccaggagacagggatgatgtctatggacattgctaccagaggactgatttgtaggttcttatggtgccacatcatgtaatccccttaatcttgattcctttattccttttgtttaccattttcctcagttcgcccaacc

SEQ ID NO: 260180 - DNA, 426 bp, Homo sapiens
caatgaaaactcccatatacctattcctggacaacagttaccaagattttgccatacttactatctcttttttaaaaaatccttttgaaatatgttaaaccaaattctgattatgaagcactgagacgttttaacacattttagtattaataatagttaaacatatatttaaaagaaaaattttaattggacatttgtagaatatctgaagtatgtttgtgaagtataatttgtaaaccagtacccaataataatcatagaagattcatgagaaaggtgtgtgaatgctttaaaaaagctattccaaatcccagctacttgggcagctgagatgggagaattgcttgagccccagagtttgaggctgcagtgagctgtgatcacaccactgcactccagcctgggcaacagagtgagagaccccta

SEQ ID NO: 260181 - DNA, 356 bp, Homo sapiens
taaaagagtctataataaaaaaagataattatgggtttgaagcatctcaaattacagaattccatagaattttggagcaaaaaacactctttcaaatctgctagtattctgaactttgaaagaattacagtattctaatgctttttagaagtgctgtaacctgagttcccaagtacaatgacatattttggttctgatgcatgaggaaatttttatcaattctgaataaatgaaaaaaaagtcaaatttttataaactcagttatattaaatttaaagaatttaatgttatctaagattttaattgtttcatgtttttaaagttcaaataatattttctcattttatttggagaaa

SEQ ID NO: 260182 - DNA, 233 bp, Homo sapiens
tttttagtagtgggtctatgttgcccaggctggtctcaaactcctgggctcaagcaatccttccacctcagcctcccaatgtgctaggattacaggcatgagccaccgtgcctagccccaagtttagagtatttttaaaaattactaatttaagtttctttgctaagaaaagagaacctaacatttgatgtaattttttcattattcctgctgagtagatagatattggacat

SEQ ID NO: 260183 - DNA, 428 bp, Homo sapiens
gccaactgggtatcatacctgtctctcaacccctcttctgcccaccaccctctctcagcctccctattccctgaagctagcatgccagggaggcaggtggcatacgtggtacaaggactgcatgcgcacattttggaatgaaacagtggcctttctttggaactcagaccatccagtgtgctctggctaaagacaggattgtagatctaagaagtccattgtactgattagtttcatctcagtttaagccactgacctaccaagagtatccattcaggaaatgtcaccccatggcctgatgtagtggtaggagactggaaatagctgagtgatgacggcatgtacactcagcattgcttagccttgggcaggtaccgaacctttctttgcctcggtttctcatttataacatgggaataatgatagta

SEQ ID NO: 260184 - DNA, 385 bp, Homo sapiens
gatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaacc

SEQ ID NO: 260185 - DNA, 492 bp, Homo sapiens
tacaggaaattctgcctcctgaatcacttttttttttctctccggtcccatgaaattattaaaatttctaccagtttctttgtatctgagtgatgtcaactcttactccattctgagaatcaaaaatgccctgagggtggaaaaggagggttgcagaatatcctctcatctctctgctcagaatctactttatccagattttatcccctcaagacttagttgttccaagtctttctcagtgagagcactggtctaccacacactcctctgtcattgctggaacctgaaacaattttcctgggaatttgtactaagaaaatctaactgtaagtaagcaagcaagaagagaatgaaatcagttagcagtaggtactaagactgtaaaatccatagaaaggagaggttggagacaaagctaatattattatgctaggccaaagttacaagaaaaagaagacagtaaaataataaaatgatataatgctgcttata

SEQ ID NO: 260186 - DNA, 441 bp, Homo sapiens
aatcccagcgtgctgcgccgatggaacgagttgatgtgcacactaggtatagggatgacttcatccccaaacgaacgcagccgactctcggggaaacgcagtcgccgggagacgcgcgcggaacagtgtgttgccgcaagagtggaagaagagaaacgcagccagtggagccgctttccagcgtcattagcaaagagggaatcccgggcagggggcggggagagagaggaactaatgataattttaaatttttcgtcattcccaatggtcttgaagtcacctcccttaaaaagtagatataaaatactggcgaggcaatttcatttcaagtcaagtcggggaggagggcatccaggaagccagaattgatcgttgttgaaggttttgttttcggttttttttaaatctaaaaacaaatccaataataaaatttttaactgt

SEQ ID NO: 260187 - DNA, 539 bp, Homo sapiens
atgcaagttcttatgagccatgtttggtgtatgtgggcaccactccgcaattctatgtccgcaagagatgtctattccaaacactgtactttttttctactccaggatgccaattaaaattaagtaggtgtacatgtgaggcacaatccattggctggtcttgatttaaaccctggtcaaggtggtaagttagaaaatgttactctaggctagccactgtccaatggaaccatatttgtgctagtatagtagctattaagccatatgtggctactgaacacttgaaatgtggctaaggaatggaatttttaatttatttaattttaatgtaaatacctacttgtagttaccacctaccatattggacagcacagcactaggcctttgagacacattttctgagacacatgtttggatttgggattgtttactgtgggtgttctgaacacgccatacccagagttacagagttacagagccattatcatcacactattaagcctctagtctatccatgtagaggataggagaaaaaaaac

SEQ ID NO: 260188 - DNA, 436 bp, Homo sapiens
tcaagcatctagctcctggccactcggccctcctgttcatcctatgtgaggagcaggaaagagtgcagcaggaccatttcttgaggatggagcctgcacctggctagttgggttgtatacaataggctattatttctctcatatttgtggctgaggtgagattgcatgttcttagtttatatttccaagtacccactgtatgcctagcactgttaaggtagttgggtacaggagtgaacatgacaaacaaggccccttccctcgtggagcttacattctagtaggaaagacagagaatgaaaacttaagttgcactgaagaaaattaatgcagattaagagacagaaaatgacaggggtgaggccattttagacaggggtgaggtaggagcatctctgaagagatggcgtctgtaggaggcaggcgttaagtgagg

SEQ ID NO: 260189 - DNA, 393 bp, Homo sapiens
ctgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatc

SEQ ID NO: 260190 - DNA, 432 bp, Homo sapiens
agccaatgggcggccacagagggaaccgtgacggtgcgtcagaaggccacgccccagcggagctgtagctgcccgcttcctgcactctctgccggctgacatgagttggcggctgaggctgtcgtggccgctgaggctgttgtggccgttcgtctgggtcctcccagccttgctttcttcgcggagcctgcggagaagccccgtcactcccgtgaggctcgacttcctagtctgtaaaacgaggatcatgccaccgccctttcccactgtcttcacccatcgaaatttagttctttaaattccagacccgagccggcgtctacaaagccttcccctctgcgcgcgtcgcttccagtaggaattcgactgttccttttataaaacagaagagggcgcccgcccttaaaaaataaaatacaggctgggagtggt

SEQ ID NO: 260191 - DNA, 175 bp, Homo sapiens
ctattctgttgtttttgttattttctaaagaaacaacatgcagagttcagaatcaaccactgagtattgttcattacctttgtagtttattagccaacagaaaatttttgtttatcactatgatggtaaaaattgttgtataactatctaacactccttcatacacacagacatt

SEQ ID NO: 260192 - DNA, 452 bp, Homo sapiens
atctttaccgtgcgacgtgttagagctgttttcacatgtgtatatatgtgtgttatttttaattcagtatttccattaaattgtaagctccccaaaggcaagatgaattttaatgatgtagttataaaatcacacagtcctagtagcatatgtgttgggaatatggttgttagctggtcgtggtggctgacgcctgtaatcccaacactttgggaggccaaggcaggtggatcacttgaggccaggagttcgagacctgcctggccaacatgacaaaactccgtctctactaaatttaaaaaattagctgggcgtggtggtacacgcctgtaatcccagctacttgggaggctcaggcacgagaatcacttgaatctaggaggcagaggttgcagtgagccgatattatgccactgcactccagcctgggtgacagagtgagactctgtctc

SEQ ID NO: 260193 - DNA, 310 bp, Homo sapiens
ccctttcttaccccaacctgcttcccctggggtctttatctcagtaaaagtcgccagctctcccctgagacctccttctcacacttcctgatggcctactctgtgctccacgtgacttcatacatgtcctgtgtactggagtcagagtcacctccaacgcgccttttagctcttagtgggttctttagttgaatctaggcccagattgagaatcgcctgtaatcctggcgcctgggaggtcggggcaagaggattccttgagtccaagagaatgagatcagcctgctcaacttaggagaccctatctcaa

SEQ ID NO: 260194 - DNA, 281 bp, Homo sapiens
ctgcataattgtttccaacttaagaggtttataaatagtcatccaataaaccctgttttatttactaaaagaacagatctttcttaccagctgtgaaacagtcattgacttctgctgtacttggccctggggatgtactgaatgtaatggtgacccaactccctgtggactctgcagcttatgatcttaaaaaaagagatgccaacaaataatttttgaagttaatataggtgggtaaaaagctgtagaggagaagtgtacaggcccacttatacatcgcg

SEQ ID NO: 260195 - DNA, 356 bp, Homo sapiens
taaaactattatttttggagaagcataactcaaagacctattagtgggaagcacccattttatgttcttatactctatgtaccaggacagagtattataatttcacccaagaaagtgaaaggcaaacaaaagaagaaaaagaaacataaagtttgacatacattattagtcattcttggagtaatagtaaatgtacaggaaccaaaaacacagagccaaaatttttaacaaaagtggctgtcagtacaacaggtaacaaattacttacctgaaagaagaatagaagagagaaagttatgaatggctggaatctcagttagcttgtaattggaaaactttcaactcaacaccaaata

SEQ ID NO: 260196 - DNA, 813 bp, Homo sapiens
aggttatctgttgctcattctgttcccctgcctgttcccctaaattcaattttcatcctaaccactgtaataaaatgacatcctaatagctaataatacttgcctttgttaaattgaattcttcttgccatatctgtaacacttgacactatagataactcttcttccttgactgttgtgtccttaaatcatccttgccttcaattacttttgtaagctcctcagggtttttctgatcatttgctctattattctgtacttttggaatagccatcacctctgtaacggtgaacctacatctggaaccccacaccctgacacacctaaacaacggtcttatctcctcaaccaacaacttggatgtgttacagttgccttaacatatttgaaataagattgatttcttgcccttttccttcaaaaataaaaacattttgcatcccaattccaatttacctgttttattttggccacatttcaagtctgaaaacattatatgtttatcagagatacattatttgtaatacagataagagttttggcattttagagggaaatctgccctgtttaagtacaaagtgaacctgttagtactaatgaacttaggaaagcctttctcttgaatgtagcagagctaataagaacttgatgtctacacttcttagagaaggaagcagcaatattcctggagtagtttctctcaaaaaactgtagtctttctgaaaaactctattaaaaaatatatgtggaactgaaaacccatgtaaatctcatgacagtgaaatgtattcctagtgctgaaacaggaacttg

SEQ ID NO: 260197 - DNA, 401 bp, Homo sapiens
agctgggggcatctggccaatttatttcccagcagacctgctgcttcccctgattccaatactttcttccccaacccaaaccaaggcgtctggcaatgttaaaaacatcaagaatgataaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctttctctgtctgttaaaggaacatgcaggttggttggtgctggttctccatctgacagttctgtctggtggcctc

SEQ ID NO: 260198 - DNA, 522 bp, Homo sapiens
ataattatattgatgaggccaaacaatgtcctctgccaatcatttctttccagtccccatatcttcttggaaaactaccccatcctttggttcttgaagagacctcaccagtgtctctcctggaaatgtatatctgtgttttgcagatactggtttaggttctgttagttcttggatgaaagcatcctggggaagcttaggctgcagcccagcatgcatgttgggacaggaaaagctagtaagagagagagtaagccatgtccctgatagctttctggtcccatccttttaagatgcttaattatctttcctacttttgagttttcatgagatgtccccttattcttcccgtaatttatataatcaaatctgaattttattgtgttacctttagccaaataaccgtaatgaaaagatgtaattctttttcttcttttttttttgttttttttttttgagtcttgctgtcgcccagacaggagtgcagtggcctagtttcagtaaataatgaaaaggaagtta

SEQ ID NO: 260199 - DNA, 453 bp, Homo sapiens
gaaggaggaatagaagagattttgccctctgttaacgggatgtgtccttacctctaataaccttcgtaacttttgcttaggtcattttcagaggtacactttgctgtgatagtaaccatgtattgaacatttgtgtccatccaaacacatgctaggtgctttgcatttgatcctcaagtgcaaccctctgagatggcgtgatgggagcccgaggctccaaagagttgggtaactttgctaagataatttctgaaggctgggacccaaaaggtggggatgtgttcaagcgtctcgtgtgactatgaaccaccagtccagtgcagggctttgcagactttttctgtgaagggctcagtagcaaatattttaggctttgtgggccacatcagatttctgttgtgtattcttctctgtgtgttgttttttcaacccttttgaagtgttaaaaaaaaa

SEQ ID NO: 260200 - DNA, 367 bp, Homo sapiens
gtttagtgtatgggcggtggtggacttagaatctggcaaaactggtttgaatgctggttctgccatgaattgaactttagtttccttctctgtaaaatggagccaatagtatctacttcacaagttataaggattaaatgggaaggtttttaaaagggcaaacaaagggccaggcatggtggctcacatctgtaatcccagcactttgggaggtcaaggcaggcggatccgtctctactaaaaaatacaaaaattagccgagcgtgctggtgggcgcctgtaatcccagctagttgggatgctgaggctggagaattgcttaaaccagggagaaagaggttgcagtgagccgagaaactccatgtca

SEQ ID NO: 260201 - DNA, 447 bp, Homo sapiens
gtcaaattcactctgaagctatcttaggtgtgtgatatttgagcacctatgtttatttatgtaatatagcactactataggaaattattttatggtttttatgtaactttttttgtgaaggaataagcatgcttatagtaatgcagctcgcaattttgttaaagagaagtttgactcttaaccaaacatatcagaatggaaccataattctaagtgactgactgctttgtttaatcacagatgtagttgcatggtgaggtgagactgatgattttgctgatcttctgcactgaactttgtgtcactattaaggcagaagaaatgacaggctttgtttttaagggcatctgcattgtaaaatagctgtcttaagaaaaatgtactgatacgaaatcagctgtattctgtgatttatgtgatttgaaaataaactgtcagtggccaaac

SEQ ID NO: 260202 - DNA, 530 bp, Homo sapiens
cgaggggatggcaggagatcaatcggacccagaacagaggcctgcaaggatgagcgcacttgatcccctcagagaaaaagccagagtgactcacaggagaaagacaaagcaaccaaagcttccagggtgtacaggaggtccaaagtcaccagaaggaagaagaaaacctgaaacagcgagagctggccaaacgctgctaagacctatgcaaataagacccacccacgctacctggaaatcgggcctgggaagtcagaaaacaaagcacatgcgtgcagggctgcacgaacggaggcggaggaggcggctccgagggagcagctgatcctgaaacagcagtggatccctgggagagcagcacagataaagatccaggcaataatgatgcttcctcctcttggacagccttttacagttctggccatggaacttcagagaaggtaggtctgatttggggggaaacaggagatcttgacgtgtagtaatacaagcttactggagtaaagttagaattttcaggtaagagaatt

SEQ ID NO: 260203 - DNA, 421 bp, Homo sapiens
cagtttgtaattaaaagtgttgctgtttgtattgttggagaaccagtgacattaatcatgctcctgctgcgagagccgagtttgcttacatcatgctggccaaggcctgccagactgccagatcagagcaggtgggatggatgatttctgggcaagtccaggaaggcccacatggtttttggtcattctttggtccattgtttttgttggttgggtcacttataattacacaaaaattagctaccacaaatcactttttaaaattgcacctgatcagatgtgttgtttacaaacatgcaaatgagtagttttccttcctgacatgatgaatttgccacaaaaacacaaatgatttttctagcttgctttatcattatttactcctccatttagaatagttgttgttatattttcaactggg

SEQ ID NO: 260204 - DNA, 457 bp, Homo sapiens
tgaacattttaaatagatgcagtttattgcatgcaaagtatgtcccaataagatgatttaaaaatattatcctctttgagacttgtactttgcttatgtgaaacaaaacaaaacaaaaaccctgttcttgtgcccaggagacacaccctgacacatctggaggtagagggtcatgctgtctgcaacttaccctcacaggctctgaaataacaataatagcagcatatttacagatttagagagagagaaatttgtggtaaaaatgttcataagtaaaactagataaagggcaaaaataaaagaaataatgaaactacgtcttttaaattttctctctccggccgggtgcggtggctcacgcctgtaatcccagcactttgagaggccgaggcaggcagatcacgaggtcaggagatcgagaccatcctggctaacacagtgaaaccccgtctctact

SEQ ID NO: 260205 - DNA, 449 bp, Homo sapiens
atgtcttttctagaggcatcagtggttaaatactgtttcctgcgggagtgtggggatgtttctcactgttttaccaccaacgatttaggctggataaggtatgaaaacttatagggcccaatgagaaacagaactgggtcctttcacacatgaaaataatattttatagacattgtgctttctctttttgtttctgttttaagtgacttacccattttaatgtgagaatatgccttactgatttagaaacatttttctttgcagacttgacaccatccttcacaatcaaacttcgcatggctaaaatgtcaaaccatggtgctaacccactctatcaaactatatagtactaactaaagagctataacacattctctactggaatgccatctccttcatgctttaaaggagagatgactagagtgaattaaataaaatgagaaaccttc

SEQ ID NO: 260206 - DNA, 439 bp, Homo sapiens
gagctcaatatagtcaagtgataggtggtcccttagaaggtcacttttataaaaagcctgtggctttcatcgtggggactctctcggctcactcccccagggaaggtgctgccaggtactgcagcactgcggagaggcccaatggcaaggagccaaggcctgccagtgacccaccagtaggcttggaaacaaacttccccttcttctcccaagctgagccttcagctgaagtcacagccatggctaaccatttgcaacctccagggcgactggaaccccgttaagccacacccagattcctgactcacagaaactccgaggtaataaatatttgtcattttaaaccaggatgttctgaggtaatctgatatgtggcaatggataactaataccaccaccaaatgtaaggtaaaaacattagatgctttgaggcaagagt

SEQ ID NO: 260207 - DNA, 513 bp, Homo sapiens
ctattaaaatattcctaatggaaacatgttaaaaatatgaagtgctaatactattttaatgcctaaaatgattatgtattaggatgggattttagccataattaaatagagcaattatttagctataagctatagcatgaggattaatttcctaatagacaagtatcctgccaactagttgactaagaatttagttgtggcctaccagtgtgcccaagtcttagattaatgaatttatatcataaaacccatgaatctttagtttcttttagatgcaaactattgaaagttgtccattgtgtctatccacatcaacagatgtaactttattatttttccctactcagagttattcctggagaataattatatttggataatttgagctatatttcttagtttctgttgccatatattatgtaatattctgtttctaattctatactattatgtcacaatctgcaaaatgtgagacaaaataaaaatgtaatttttcgaaatgtttagtcaaat

SEQ ID NO: 260208 - DNA, 451 bp, Homo sapiens
cccctgtcaatgggacatagggctggggctatcttctcattcacacctacatgcatcggttatcttcagttggggctcttccagccttaggaacaaatgaaacgtcccggagttgggaaaattacaacaactgctatataggtcagataaaagtggtgttttcataccaacttgggatctcttacagtagcccctgaccttaagacataaataaatacaaacaatctaacattttttttctcctaaattctctgttgacccacttactttatcttatggatgattttaagaggaaaatccttttacttccatttaaatttcattttaagttactttggttttacttttgttcatttggttttactttttaaggaaaaaggaagctgagaccaaaggggaatgttaccttctctgatttattcaacttctattttgcgtctaccttaaggtt

SEQ ID NO: 260209 - DNA, 436 bp, Homo sapiens
tcagagtgatggtcactgtcagtgaatagactttgagtgaagggtgtaattgcagcctatactggaataaagtggatgtttctgtatcggtgccaagtcggcccacacttagtcagcatgcagaaggaggctcaccgtgatgctctctctcctctgggagctttgccaattaagcatcctcacttgcagaggttataatgacagatcttgagatgagaaaaaatgataatttcactgtattatataatagtcttaacgttctgcatctggggcttttaccctatttgcatttgaatatgtgtttttacaattcgggtgccacattgtgggagggtatttggcaacatttggaacatagaaaatatatccagtgtctctccttggcaagaggaaaaaaaacatctgagaagtctcagagcttgttcactaatgcctt

SEQ ID NO: 260210 - DNA, 470 bp, Homo sapiens
tcccccacctccccaagaggttctgattcaatttgcctgaaaggttgcctgggaatcaaggcttttaaaagctgcccaggtaatcctaatgagcaatcaaggttgagaacctcttgtccatagggcctctctaccatttattgagccgctcatggggtcagaccttggacagcctgctttgcagccattctgcttggagtttgctttgtcagcttaagccatggcagagggaggaagagggagaaacttacaccatctaaggctaaaatcctcttatttaaattggagtctgaatttccaaatcaaaactggagattcacaagataaataagtgctagagatctgctgtacaaccttgtcccttcagttaacgatactgtattatacacttaaaattttgttaagaagttagatctcatattatgtgatcttatcacagtaaaataaaaattttttaaaccctcaaaaaa

SEQ ID NO: 260211 - DNA, 750 bp, Homo sapiens
agcaggggcaggaggcagggcggggagggcagaggggtcagggctgaggaggagaagcaggggcaggagcggtgaggaagaggggcatttggtcgaggttgggtcaggtaaggacacggtggtaggcaaaggccagggggcaggtggggtgcctgggaggtccgtggtcagaggacgggtgctggtggggcctggagatggcggtgctgcctccaccctcctgagcctggaggcctgacaattgcatccgaaaaatccacagccaccatcgtgtcagcagcacgttgaccatggctcacgacatggggacgggcattcttgccgcttcctcagaatattaacgacgtcctcccgggagcccctagcaccttgggcctgcccccagcctctctctcgtctttgggcagaactcgagtgctgctagacccttggccccgctcactgcgctgggccgcactgcacccatttcctcccagcaagggcggtccctggactcctctgacctgaactgcttccgagtttgcttctcagaaccaagaggggctggctctgcgccctgcctacctgtccaggggtgggggctgccctttgaagctatcaatctgggttttaagtgtggattcattattgacaacaccatgacattatgctgacatgaattatttgtatgtttttcaaattgtgctgtgataaccctggctgtcttcctgctcccatagtggataaaagcgtccgaaagaatgccgccat

SEQ ID NO: 260212 - DNA, 1122 bp, Homo sapiens
cgactaatggggacagccggagccaaggggctctcagggcagcaggagggccatgcagggccaccatcgtgtcagcagcacgttgaccatggctcacgacatggggacgggcattcttgccgcttcctcagaatattaacgacggtcccagcagaatgctgtatgaatattcatatggagctcaatcaagcctgggctggcggatggcacagggagaggcgccgtgacaggctgggcccgggtcccagtgggcacaccttggcagggtgtggccgtaagtctccgccagctccagccaggatctgcctccctcgggatgggacaggcctgggcctgttgtatggccacaggcagaagaggccgatgagtgacatgacatcaccacttagtgactgccctcgtcctgggagcccagatgctggggcggggctccttcctgaaagacccagagaagttcatctcaggtttaatgggggcactgctgcctcagaagccaggcagtgggtggtgaggtccctgtcctcactggggtctgcagccgaggaggactggccaccgaggcccaggccaggcacagggatgctgggtggccatggccagtcctcccgggagcccctagcaccttgggcctgcccccagctctcacgccgggagaggttttttcccactccggtggccgacgccctggtgaagggattcgcagaacgggagcacatggatttccagttcttcccagcgggcgcacgtaggccggcaccctctctctcgtctttgggcagaactcgagtgctgctagacccttggccccgctcactgcgctgggccgcactgcacccatttcctcccagcaagggcggtccctggactcctctgacctgaactgcttccgagtttgcttctcagaaccaagaggggctggctctgcgccctgcctacctgtccaggggtgggggctgccctttgaagctatcaatctgggttttaagtgtggattcattattgacaacaccatgacattatgctgacatgaattatttgtatgtttttcaaattgtgctgtgataaccctggctgtcttcctgctcccatagtggataaaagcgtccgaaagaatgccgccat

SEQ ID NO: 260213 - DNA, 1324 bp, Homo sapiens
agcaggggcaggaggcagggcggggagggcagaggggtcagggctgaggaggagaagcaggggcaggagcggtgaggaagaggggcatttggtcgaggttgggtcaggtaaggacacggtggtaggcaaaggccagggggcaggtggggtgcctgggaggtccgtggtcagaggacgggtgctggtggggcctggagatggcggtgctgcctccaccctcctgagcctggaggcctgacaattgcatccgaaaaatccacagccaccatcgtgtcagcagcacgttgaccatggctcacgacatggggacgggcattcttgccgcttcctcagaatattaacgacggtcccagcagaatgctgtatgaatattcatatggagctcaatcaagcctgggctggcggatggcacagggagaggcgccgtgacaggctgggcccgggtcccagtgggcacaccttggcagggtgtggccgtaagtctccgccagctccagccaggatctgcctccctcgggatgggacaggcctgggcctgttgtatggccacaggcagaagaggccgatgagtgacatgacatcaccacttagtgactgccctcgtcctgggagcccagatgctggggcggggctccttcctgaaagacccagagaagttcatctcaggtttaatgggggcactgctgcctcagaagccaggcagtgggtggtgaggtccctgtcctcactggggtctgcagccgaggaggactggccaccgaggcccaggccaggcacagggatgctgggtggccatggccagtcctcccgggagcccctagcaccttgggcctgcccccagctctcacgccgggagaggttttttcccactccggtggccgacgccctggtgaagggattcgcagaacgggagcacatggatttccagttcttcccagcgggcgcacgtaggccggcaccctctctctcgtctttgggcagaactcgagtgctgctagacccttggccccgctcactgcgctgggccgcactgcacccatttcctcccagcaagggcggtccctggactcctctgacctgaactgcttccgagtttgcttctcagaaccaagaggggctggctctgcgccctgcctacctgtccaggggtgggggctgccctttgaagctatcaatctgggttttaagtgtggattcattattgacaacaccatgacattatgctgacatgaattatttgtatgtttttcaaattgtgctgtgataaccctggctgtcttcctgctcccatagtggataaaagcgtccgaaagaatgccgccat

SEQ ID NO: 260214 - DNA, 369 bp, Homo sapiens
gccccagagtcacatttcctgttggggcccatcctgctcatatgcggcaccatcagacttctgggcaggcaagattacctgtgactctgtctgatggtctcgccatcaatatcactgagagtagctgtgtatggagtcccgaactggtacaggataaaacagggggctgaaaagggaatgaatgggcacagtttctctggcatcaaaagtcacatccagaattgatatttcctgttgagtaaaaatagaaatataagttgctcagtggatgttgagtgagccctattcatgtgccccactctgtgccaagcaccaggaaggagggaagggaaaaatgataagatgttctccccgttctccaggagttta

SEQ ID NO: 260215 - DNA, 419 bp, Homo sapiens
caagagtaggctctttcggaagtacttgcccgtattacactttaattttacaaaccaaacaacagcaattcaaccaatcaaacaacaaaaacaatccaaagaaagagacttggacataggcatcaaggaatcatttcactttataatttaatagaacactggtgtatcattcattaattctgaaagtgagaactaaatgtaaaataattttgtaaggtttgtgaattgttgcctaggtattctggtgatgtttactttagtgattttatcattaatgaaagcaatgtgtttttttagaaaacatattattagggttcataacgttgacattctgttgtgcaatcataatctcctgttttgttttagtcatagctctacagttgaatgaattcaaagctcacctccaggccttttgctat

SEQ ID NO: 260216 - DNA, 2877 bp, Homo sapiens
ccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatcatgttctcatgcagcatgaaaagctctcaccagaagccaagtggatgctggcagcacatttcttgtaacttcccaggctgcagaacattggctaaatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaataaatccttttttgctttaaaaaggaa

SEQ ID NO: 260217 - DNA, 2611 bp, Homo sapiens
ccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaagagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaataaatccttttttgctttaaaaaggaa

SEQ ID NO: 260218 - DNA, 1637 bp, Homo sapiens
ccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaagg

SEQ ID NO: 260219 - DNA, 3137 bp, Homo sapiens
caagtcatgccagtgcaaaattatcccatgccatgccatgattagtctcagaaacactaccccccagcagggtcttgggcagttttcctcattagcatgaccatttcatctgagggattatgcttggatacttggagccaggatgcaggcaggtaaatacagccattcaggagtgggacagcaaaggcagacctacctggaagcaggacccagagattgagcaagaacctgcgaaaggagggactgagtgctgggctgaggtcctggagcccagaagtggtcactagcaaattttgcttgagtagtaccaatatagtgattcctaagaagatggttggtggtcttagtgtgggtctttcatctcagtcattatattccatcactatttgggaataaaataagagcaatattttttttactgcaatttacttcccccacagcctgggaaatagggtgggaaggtatcacgtacatgtttatgatctggaactcattattctgagactttagcgtgcatcaaaatcattgcattgaagattcaaaatgttgatttctgggctccacctctactatctgcacttagagcaactactttagggaatcctgatgcaggtattccactgaaaactactgctgggaacagcagtgctccaagcaacgttcaatgttcttccttctcttgttatcttaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaataaatccttttttgctttaaaaaggaa

SEQ ID NO: 260220 - DNA, 2781 bp, Homo sapiens
ccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctggttttgcttttgtgcttaggcaagtgcaaaatactctatggaaatcataattgtcatcttcttcatggtgttagggatatattgtcacatgatttcaataaatccttttttgctttaaaaaggaa

SEQ ID NO: 260221 - DNA, 389 bp, Homo sapiens
gacttcctgtgattcttattggggaatactccattagacaagaatctctttgacataagccattctctacctgagatccctgtaaggctgtgatgggaccacataaccttaaaattattagaagactcattgtttactgagagaatatgcctagcatatgcttagatccttagaggaactctgtttcaaagggcttatgagacattaccttatatctttctaaggtacaaacaaaaggtctttggcttttgagtttgatctttgagctgacaccttttcttaatttgagaatcccctgctctatggagagactgacaaagagaaatagttttatatttgaatgtaacatcttggatctttaatagattatcttaaaattttcctgaaaa

SEQ ID NO: 260222 - DNA, 421 bp, Homo sapiens
ccaggctggagtgcagagtgcaatcacagtgcactgcagcctctgcctcctgggctcaagcgatcctcccaccccagactccagagtagctgggcctagaggcacacgccacctcagctagtttttgtactttgtggagagacagggtttcgctttgttgcccagactggtcttgaactcctaggctcgagagatccacctgtctcagcctcccaaagtgctgggattataggcatgaggttgcagtgagctgagatcgcgccactgcattccagcgtgggtgacagaggggagactctgtctccaaaaaaaaaagtataggaaaacggaagttgctctacaaattattaattttcaaatagttacagaaattgcataaattattaaatcctgaaattaacctattaatatttcttcggga

SEQ ID NO: 260223 - DNA, 354 bp, Homo sapiens
ctgtctatggaatggctcctggctcttgggcctcaggtgggaggttaaaggaaggtcttaaactgaatctctacatcttgtaggaatgatgtcattcttcttaaagaccagacaggcccagcagctgagtaattggccacaggtatcctatctacaacattagaagagaaaattgaattccagtgattttgtaaagtcctattttagtctttcctgtcaacagtcttactagacctgttcatcgtgactaaactgagtttctcatccttccacttccttcttgtccttttattggaaatatatctcaaagaggaaaagcaagtttaaaagccaaagttctttaaaaaaaaaaaa

SEQ ID NO: 260224 - DNA, 206 bp, Homo sapiens
gctttgtgttactttgtggggtcttgaggggtcttgaagattatgggataatgtaagtatagcacagagcctgacatttgcgatgggctcagtaagtgccgtccgttctcttgtactatttttcttctccttctccttcttcttcttctttgagagagggagagagaaaagaaagaaagaaaagaaaagaaaagaaggaaagaaag

SEQ ID NO: 260225 - DNA, 907 bp, Homo sapiens
cctgctacacaaatatgtaattaaccaatgaggactcatgacttgatagtgtatgtatgtaaagggatatatggacttaatcataagctgttgaggtgaaagacgtggatccacctgctttccaagaaaactcggccaaatttatttgcagctggatattgaatgggacttttctggttgtcttagaattctggctaaaggctcaaagctgacgaaagacagtaactgcaccaacatgatactagacacagccagtctggacttatcaaaagagcagaaagagaccaatgactcccagtccgtattatccatctctagaagactagagtcaaaagcgtgattaaagagtcattaagcggaggttctaggccatagggagattgctttgaatttcttgcagacaagtgtgagggactcagcatggtagaaggtagcctggcatcccactccaagactgaaagcttgcagagtaacaggagcacacaggttcagtgcagcagatgtggtgtggcttgagaattcttggaagagcttgatgagtgtttgctggagtttgggatgagggtgggcactgggaacacagagactggtaaatagtgtttggcaaatacaagtgcttgatgaatatttgttgaatgaatagatgagttcttcccccctggggaattcaggaggtgaaaggttggcttgagcacccaaaatggcaggatgagagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcaagatattcgacgtggggggatcctctatgagat

SEQ ID NO: 260226 - DNA, 520 bp, Homo sapiens
gagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcagtaagaggacacggggttaggcagaagaggggtttggggtggaggttgctgcaagaggtcagccagataatgtggccctgcatcatggaactgtgcaatgtggggtacactcaaggccctccaataactcacagatgtgccctatgaaaaagccagcatttggactctgccatagcagctggcaggatcatgctggcctgtctgccttattcaatagttaactacaggaagatctgctcctctttgtgtaataccctcttcccttgcaatggcatagggacatctagaatatagagaagacagagacaatggaggaagagtaaagaaactgactatatgccttcgtcatttcactgca

SEQ ID NO: 260227 - DNA, 383 bp, Homo sapiens
ttttgagacagggtctctcactctgtcacccaggctggagtacagtggtgcaatctcagctcactgcaacctctccctctggggctcaagtgatcctcccaactcaacctccagagtagctgggactacagatgaggttttgccatgttccccaggctggtcttaaaactcctgggctcaagtgatctgcctgtcttggcctcccgaagtgctgggattacacacgtgagccacagcatctggccagaagcaatttttaaataaatttagtaaaacctaagtgtacaatgtttttaaagtctagagcaatatacagaaaggccttcactttcactcatgccactcacccacacaacttccagtcttggaagttccaatcatga

SEQ ID NO: 260228 - DNA, 389 bp, Homo sapiens
ttccaagtaactagctgcagactctgatgaaagaaacatgtccttggtgcatacgtgtcgtagcctgcacctaattaattcctgctgtttttttaatactgtgactgtgttctatttgttatatgctcagggtaacaaatgagtttcagacgtccctgcgtcagctccttcctcagcagggacctgacgggctcactgatctaagaaaggaaatggaaaatgaaaatccaccccacaagtctaataagttggtgtagtcacttctgcatggggacatgcattccagatgataacctgttaaatcactgccagttaacagtgataacctgttaaactggcacagaacctggcacattgtacaaactcaataaatattcatggatgaatag

SEQ ID NO: 260229 - DNA, 765 bp, Homo sapiens
tgtgggcagcagacgatgccgactggaagggagggagagggagggggagggagaaaatggggctatgcctggcttaggggcaacctcgtactgagaggaggtgataccgggtcctaggtaggtagggctgatggtgcgcactccttaaagaggactatttagcctctcccccagtgcttcagccccacccgataattttattttatttcttatttataaattgtaatataatgattcccttgcccagcttgccaaggtgaggggctggggcatggcattaacactgtctgacacagccagccagtctgacatctgacgttttcctgcaaggtgggctaataaagggaaggctttcaggagcttactggaaaacacttccattcagagggtgattcacctccagagagggggataaaggtggccaacctgagttaacagcttacttccggctccccctccttcctcagcagggtctttgggacccttttcctcccttcagaaggggcatcccaacccataagcaacagagcccacaagagtcgtacccttttccaggctgctgtttccgtctcccatccagagaggaccagcatttcgctcctgcggctgaagggtccagggttgtcccaggtgggaaagactgtgcacacctcttctctgtttataggggctccagcaggggctcaggcccctatgagtactgatactcaaagcatctagtcccctattgttagccagtagtcctggtccccatcctaccttggt

SEQ ID NO: 260230 - DNA, 245 bp, Homo sapiens
gagaataaagagaatgggttaaagggtacaaacatacagtaggagagaaggaatagattaaatgcttgatagcagagtagggttactataatgaacaaaaaatgtattgtattaggcgatggacatcttaaataccctgacttgatcactatgcattacatacacgtatcaaaatttctcatgtacccaatacatttatacaaacaaacaaaaacaagaaaattaagcaaaaaaagaaaaaaaaa

SEQ ID NO: 260231 - DNA, 429 bp, Homo sapiens
ctacagttattttaattttgggtgttggatagactagggttcatattccatgcctgccatgctttttgtgaacttgggcaaaatagttagctcttctgagactcacttttgtcacctagtaaatgggttcagctgtagtactctatgtatttgtttgttttaagcattagatagtgcgtggtaaatgcttagcacagttcttagcacatagtaaatctttaataaatgttagaaaatataatgatcttgattctctgtcttccctccctagtagttgatttggggcacagtgtagcattatttgaattatcacagaataactttttacctttctgattttaacaggggagagtgtgtaaaggatgggagagggaagagagaaaaaagctgagtaaatgtgatcaactttacagtctttattccctgaac

SEQ ID NO: 260232 - DNA, 494 bp, Homo sapiens
ggattattctgcctacttctttctggtggttcttcccccagccttaatagttttattacatgtatgtactgaccgatccttagttacttgtatagtgatttaacttcaaatgagattatcacaatgcattaataatggcaccttaatttacaggatatataacttcagattatcatatagaggccaccatgctaggtgccggcagtgataagataaataagttttagtttctattttcatgaagctcatagtctgttagggaagaaagacatatagacacagttcaagaccagcctggccacatggtgaaacctggtctgtactaaaaatacaaaaattagccaggcgtggtggcaggcacctgtaattccagctactcgggaggctgatgcacgagaatctcttgaacccgggaggcggaggttgcagtgagccaagattgtgccactgcactccagccggggcaacagagtgagacttcaccaaaaaaaaaa

SEQ ID NO: 260233 - DNA, 691 bp, Homo sapiens
gagttttgatttaaaagtgtagagacaagggttcttatttgaactttctacctaattgtaatattgggaaatttattcaacagtcagatattatagagtattattgattaaaagcacaaaaaacttgagttagggaatttgggtttgaatctcagtgccggcacttattagcttaagtcactttcttgaggctagtcttctcatctgtaaaatgggaagagtgataattactttctgaaaatatgtgtaagtacaaagtgctatactttattctaaataatttcatgattcgttcatatgtgcaattttattactataaaattgttaataaatgtaaaatgattttttcatcagaaattatacttttcaattttatggctcagaaggtgctattgaattgataaactgcttagtggttaaataagacattgtaaaaaaacaaaatgcaattactgtgataaaggtgttcatataaatgactctttccatgcacaaaagtcaaaatcaaatgaaatgtaaaacctaagtttatgtacataatatgccatcagttatttgtggttaagttgtaacaaaacacaatcaaccacatgaaattaatgtgtaatttaattaatgacttgaatgcttttaagcgaatacattttaattttattaaaaataatgatcttgataattatattaatcaact

SEQ ID NO: 260234 - DNA, 426 bp, Homo sapiens
tcttttgcacatattctatacctgcttttcccattcatttcaataatttccaaccaaagaaggcagttctcagcctccaagggaatgtatgagtcattgggacagagtataaaaaaggtgacaaataagatggcttctgggtataagcgaagataaaaactaaaagcctatgccaattttgtgatcatcatagacacaaaatggtattctgtaactgcaggacacagaccctgaaaggactttaatagacttctggtcaagttatcttatgttggcattattgcagttcatatgtacatgtgtgtacatgagcgtgcctaactttttctttaatgtaactaacatgacttggtgttttagtcatcttggagaggctactcggagatccctgataagagtcactttcattctgcagttcatgtttta

SEQ ID NO: 260235 - DNA, 247 bp, Homo sapiens
taatatgtttcagtgtttaatgtcactttctttactgcctatgagataaactagtggaaaagtattggctcaaaaagccagcaggtctgctggtgttaccagtcatgttgcaattgtatttacctatcagaacgttgatctaaataataaacctaacatttccttctaaactgtcagtggaaagatatatttattacaatgtcctccatcgttgaggagagaggaggtttagctaaagtttaaatga

SEQ ID NO: 260236 - DNA, 276 bp, Homo sapiens
aactgtaaattaaagaatctctgcatctacctctaacctgtaagcccctgttttaagataccctgcattttggggccaaaccaatgtataccttctgtgtgttgatttatgtccttgcttgtaactcctgtctccctaaaatgtataaaagcaaactgtaactccaccaccttgggcctggggaccacttactcaaggcttcttgggtttgtgttttctccaggctgtggtcactcatcctggctcagaataaacctctttaaaatgttttacaga

SEQ ID NO: 260237 - DNA, 339 bp, Homo sapiens
aggacagcaagggaagccccagctcaaagaagtgactgggctagggcggccctccttaaagatgcttctgcctgcctgccgagtgtcactgttgagctcttccctagtgcagagctttgcactgctttcatttgtttttgttattcactctttcatgcaaaactgaaattgaactggatctgaagacactgaaaaatgtctgggtagggggctgcagggagcaggggttttcctgagagaatggaatgtcccatgagaaatttcacttaccatgagaggggaagtccatttcgtatgacatgatataacactgtcattataaactctccgttggtttcc

SEQ ID NO: 260238 - DNA, 550 bp, Homo sapiens
tctctccttgatggctacaaatacggcccacacacaagcataatataataattcctcctctttactgagatcctctgaggtcaggtccttcatttccatgaacaggtaagagcaaggcagttattgatcccaacatttttagatgaggaaactgagaagctacaatagtttggagagccagaagcagaatttaaaaccaggtctgtctaactccaaagcccacattctttctttgttagaaactgcctttattgcattaagaaaagaagccagaaggtggtgagaagcaaatggaaaggatggaagagaggagagacgaagcaacgcccatcgagacagcagacagggctaagtggatctacacagagaagcacttaacctcaccttcacatatttctagacaaagctcggagaaaaagaatcaagtgagtccacagcattgtagctaaatgcggggcataggagggcctgctcacagcaatggaaactagagcaaggtggaagagacagccacagattttatctaactgttcacactcaaatgaaaaac

SEQ ID NO: 260239 - DNA, 402 bp, Homo sapiens
caggtgcccaccatcatggctggctaatttttgtatttttagtagagacggggtttcaccatattggccaggctggtctcgaactcctgaccttgtgatccatccgccttggcctcccaaagtgctgggattacaggcgtgagcgcactcactttttaattatctgaacctctctccagaaaggaaactccctggggaaggactatcatcatcttcttcactactgtctactcagtgcccagacacagccccgcacagagaagacaccagaaaagattgtcggcctgcacaaaggcatctgagtaggagagagacagaatcaaagcagtgtttcagggcctggtgcagtggctcacgcctgtaatcccagtgctttgggaggctgaggcgggaggatcgctt

SEQ ID NO: 260240 - DNA, 217 bp, Homo sapiens
tcgcggccagtgcaggctttccagacggtggcagcgcccagcagccgttgcctcagctctttggtggcagccaggccaacaagggcagcaacgatgactaggatgatgagtgagcaaacagctccacactggtggacaggctgggtgcgcacccggtggtcctcaaaggctcgctgggcctgtaccaccgttataaatttgagatcatgagattata

SEQ ID NO: 260241 - DNA, 286 bp, Homo sapiens
gttggcattcactgttaaactgatagaatacctgatcattcccactaagccaaaggcatagggtaaaaatacggcaagagacccttctaaaatgtggcttctttttccacccacagaaacgctatattattataattcaaaacagaatatggtcaataaaatatttttatactaaacttttaatttagaatgaatacattaaaaaataaacagttgctgactgcgtaaaggagaaaaattcactgctgatacttacagttttttttttaagaaagcagcgattttg

SEQ ID NO: 260242 - DNA, 483 bp, Homo sapiens
actttggacttctttacccaaccagtcatcttgcacaaacagtaaactccctcaaaactttctgttcccatgggacccttgagaaaacaaaatgaaaaaaaaaaaaaaaaaagcatgattgaaatctactttcttcggtcaacatcctaacattgagcaatttcttcacatcttaaaagggactgtcctggcgtcagattaagagttagtgaactccctattgatcaaataactggaactagtagtaaccagagtcagaattccgagattacaaacacttgttccgtaatcatttcccgttcctccccatagcatcatgaagcccttattcatgttcaattcacctttggaaagcaatggtttctaaatttttagatcacatgtggtaaaaatttttgaacatgtccatcctatgtattctcatttataaattacatatgtattactctattctatgcatcaaaaacacatgcaccaaaaaaa

SEQ ID NO: 260243 - DNA, 228 bp, Homo sapiens
gtctcaaaaaaaaaaaaatagcttatatttccataaagtaaccggcagtacagaaataaacacaagcacagctgtcatggagattggtccccatgtcaataatttttcagttaaagacgtgtaaagccatgttgcattttcagaaccacaggcacaaatggaatctggcctggccctgtgttccagaagaaattaagtttaatgcagccaagtgtggtggcttacgcc

SEQ ID NO: 260244 - DNA, 645 bp, Homo sapiens
cccggctggggcacatggtgtgatcatagctcactgtaacttcacacacctgggcttgagtggttctcccacctcagcttcctgagtagcctaggactacagatgtgtaccaccatgcccagctaattataaaaaaattcttggccaggcacagtggctcatgcctataatcccaatactttgggaggctgaggcaggaagatctcttgagactaggcattcaagactagcctgggcaacatagcaacaccccgtctctattaaaacataataataacaatacaatttatttatttatttatttagttatttatagatggagtcttgctctgtcacccaggctggagtgcatagcctcagcttcccaagtagctgggactataggcacatgccaccaagcccggctaacttttgtatttttagtagaaatggggtttctactaaactcccaacactttgggagggtgaggtgggtgcatcatctgaggtcaggagtttgaaaccagcctggccaacatggggcctctggtttactttacacaattttgcctggcctggggctctcaccctctatccaagtatcttggaagcgttgtacggctaattccgttacctccgcccgctgatttccgcccccccgctccc

SEQ ID NO: 260245 - DNA, 558 bp, Homo sapiens
gctaaaggagtgcttgtaagaaatttttaattgaaaataagtagccaagtgaagaaggggaaaagagtaaggaaagaattcactgcatggaaagcagaaaataatgaaatagaacataggaatttataaataatcccagcactggtactttggacctgaaaataatgaaatagagaaaccattagcttaattgtggtaggttatattattttttcatacctttttttttcccttcatgcccttgttatagttgacagtggttattctttcctgttacactgatgttggccctggtcatatggaaggtgattggtcataacatgacatgtctgaccagaggccttcggtgttcttgtgtaatttttcttggcctcttatactcttgctgtgagaacttttctcaggtagttgctgctttatgtgtgggtcctgaaatgacatacatagaacagactgtaacagtccagctgagccatagccagcctgcagacctgtaagcaataacctcactaataaactaatctaacaagaaaaaaaagggaaaaagcagaaatttca

SEQ ID NO: 260246 - DNA, 6782 bp, Homo sapiens
gttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgtaaaaaaaaaaa

SEQ ID NO: 260247 - DNA, 7050 bp, Homo sapiens
gttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatcatggcagcagatgatgacaatggtgatggaacaagtttatttgatgtcttttctgcttctcctcttaagaacaatgatgaaggctcactggacatatacgctgggttggacagtgctgtttctgacagcgcttccaaatcctgtgtaccatcaagaaattgtttggacttatatgaagagatcctgactgaagaaggaactgcaaaggaggcaacatataatgatttgcaagtagaatatggaaaatgtcaactacaaatgaaagagctgatgaaaaaatttaaagaaatacagacacagaatttcagcttaataaacgaaaaccagtctcttaagaagaatatttcagcacttatcaaaactgccagagtggaaataaaccgcaaggatgaagaaataagtaatcttcaccaaagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaagaaatgatgaccgggaaattttattggagtgtcagaaaagagggccatcatttaaaacatttgcatatttagccgccaagttggataaaaatccaaatcaggtctcagaaagattccagcagctaatgaagctctttgaaaagtcaaaatgcaggtagttaatggttacactacaggagactagtaaaataaatgtttgacactgtagttgtgcagttaatggcctgttagtcattgaagatgtgaatagtgggtgagagacatccagttgagttcctgcttcagtcacaggttggaggatgattgctcgagcaggcatctaaggtgacctcatccacagggacgtgctcagagtgaagcctgctgcagttcagatcagcatggcatctctcctcaaccttctgattgctgatgagtctaagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgtaaaaaaaaaaa

SEQ ID NO: 260248 - DNA, 235 bp, Homo sapiens
ttactcactgtgtgacctctgcccagcctgagaatgggcctcagacaccttgcactgccagtgcctaaagcctggtggctggtgagcgctcaacacggttgacatgaacattcaaatctcagggatcatctagataactcagtgttcaacatgatcttaatttctgtgttttccaatcaagttaataaatatctgtcttcgtaccaggaaaaattcaatattattttaaaggaga

SEQ ID NO: 260249 - DNA, 639 bp, Homo sapiens
tgctttgggaggccgaggtgggcggatcacttgaggtcaggagctcaagaccagcctggccaatatgatgaaaccccgtctctactaaaaatacaaaaactagccgtgcatggtggcgcgtgcctgtaatcccagctactcgggaggctgaggcagtaggatcacttggcagtaggttggcagaggttgcagtaaactgagattgcaccactgcactccagcctgggggacagagcaagaccctgtctcaaaaaaaaaaaaaaacaataaaaagtatgatcctccctttcataaagtccaattagggaagaaaaggcataataattgtaattaatataggcagtgaaaagtgccagcccagagggacagcttaggtgctgctgggaaggttcagataaggaagaaattacttccagcttttggaatgaacatattaagatggcaatatttagacagatgaaatggacatctcgacagaggagtcgatgtgaataaatacacagaggtgggaaagtggaaggtattgataaagagaaagaaatacttgagtgtgtgtgtgtgtgtgtgtgtgtgtgtgtgtacatgtagggggtacttggtggaacagtagtaggaactgtaaccagaaaatgggagagt

SEQ ID NO: 260250 - DNA, 260 bp, Homo sapiens
aaggtatggaaatgtagtccctcaggagagcagctggatgccctggggctgagggaaatctcctgggacacccttaacctaaaaagataaccccttgggacataaggattttatttcttcaaagctagttttcatcccttggagacacattgctggtcagccaatcgtttgctggtattgaggggaaacagtcacaaatgattcctgccccctagattcattcagatttgtgaagggagaaaaactcccaaaggacctga

SEQ ID NO: 260251 - DNA, 872 bp, Homo sapiens
attctaaagtcaaagaaaacttcaaacttatgtgaatatttaaaatcctaaaattgtgctcccggaaacagagttgtagcaataaaagaaacctttctagtcttgtttagagcttgtatactccagtagtttgtaaactgtcatttacagagccctattcctcagggatctgggggcatagggttgggaagcagggggtgccaggccatgcaaacctagtttcacccagagtatttcttctttcacatatttatacatgagccttttgaataaaattgtattgaaaatagttttgccattaaatcagtttgaaaaacactagtataaccttcagactacctctataaccttggtaactctgggcctccaattcctggtctgtaaaataagagaatggtgctatgatgcttatgtttttattttgaaccctcacctactttcaagtgaaaaaaaaaaaagaccccaagagaggctaagtggtttacccaggccacacagagttaatgacagaaccaagacaagaattgaaccaccaactttagttgtttttcctctctcacatcctttttttaaaaactcctacaaagtagatataaacaaactatgaaattatatggaaaaggtatatctatcatgaggtatataagccgcatgtaaaaatagaactataccgtatcataaatttgccttatttaagtctcgtgtgctagatgtaacatacattaattgaacattaacctaattttatattcattcttcaagtttataaaaatatttgggggaattgtttgcatagcccctttctcttttacaaagctatctatgagttgttttcttccttataaatttccacataatcagtggaagcattt

SEQ ID NO: 260252 - DNA, 531 bp, Homo sapiens
agtcaacaaaagtagagggtctcatctagcctgctgcagccatctcatgccatcacatccactgtggctagagcttagattctgctgaagtaaggaccagctaacattgaccatctcacctgactcgggagagaagaatctgttggaatttgatcacaagtgtgtgctgtcagatcgtcctagttcgggacacttttgtgtaaccagattttaaaaaccattttacgttattcatgcccttgatctttcaagctgtggaacatcaatttcctcctcttcactttcaccactgttcacaaaagtaggtaaacggtggccccttttcccctcccagtttctttgattctgtggacttgtgctgatagccactagagggtgtaccaggggtctctggagtctgggtctcttacagatggatttgaaaagtcaaaagtcaatcattgcagagccctcagaggtgaagagccagactgcagtgcagatgcaggaacagaattttagagctggaattaatcaaggagaattaccaca

SEQ ID NO: 260253 - DNA, 417 bp, Homo sapiens
agcatgtccaaacccattgcaagtaagctaaaaaccttgataaaaggttatatggaaggctaactaggataaacagtgtagagaagaccttaaatggagctaaaaaccatggcacaagaacttcgtgatgcatacataagcttcaatacctgatttcatcaagtggaagaaagagtatcagtgattgaagatcaaattaatgaaatgaagtgagaagaaaaggttagagaagaaaagagtaaaaagaaatgaacaaaacctccaagaaatacaggactatgtgaaaagaccaaatctatgtttaatagatatatctgaaagtgatggggagaatggatccaagttgaaaaacgctcttcaggatattatccaggacaacttccccaacctagcaaagcaggccaacattcaaattca

SEQ ID NO: 260254 - DNA, 680 bp, Homo sapiens
actataggtatttgtggtggcaaggagggttggtggggattttctacttgccttttctcagcaatgggaaggccctcctgaccccaggcaaatctgatccaggcagaggatatggggctccacgttgccctcctgaacttccaatcaccacgggtgcatctctactcccctgctgtatgtcagcactctcccttagctgtttattaattgccttggttcttgtttggggtggtgaatgccaggtgtctctagttagccatctttcttccataattcataatctgaagcatttttttttgttttggggtcttagcacatttgcacattgattttggtacagttgtaaatccctgcctagagtagggccaggttcatgaacatagtcaccatgtcactatgatttattgcatgtttcccaattgctaggcattgtgctgagggcttcattttctctacagaaagtgtaacaaatttcagagctacagagctgaagttaggcaccatgagttcaaatccttgctccttcttccactaactcttttctatagagataaactaatatgacaggtgacttctattgtgtaatccactgtgccagctgtaggttaaatgcttccatacatcccttatttgtgaaacaccttcatcaagtatgtggcattttcatttccattttatag

SEQ ID NO: 260255 - DNA, 663 bp, Homo sapiens
cagtgttcaaggctcccgaggtctgtctgcccagtctcagctctctttacatgtgtatccccagtcctctactctccccaacgtcggggacactgtacacatcacccccctcgatggggttctagcatttcattctatgacccacttccttctccttctcttcttccctccacaagcattcatggattgcctgctgtttgctaggcactggtgaaattgtgacaatcaaagaagaaatagtccctgaccacatggggcttatactccaaaacgagttttctctatggacatgttgagaacactgttgatgtgttgggttgggtcattttttgttatggggatctgtcctgtgcatggtaggctgcttggcagcatccctgccttctgtccaataaatgtcagtagtatactccctcctcagttgtgacaatgaaaaatgtcttcagatattgccagttgccctgtgggggccaaaatcatccctggctgaaaaccatttttctcatcagatgctaaattaactgcaccaataatcattttattacaactagttgcagagagagagaaaggcagggcttgaaaatgcagaacaaggggcctgctgtggtctggaggggagtgcaggagtggggaaggtcagggaaacttcccagaagaggcaca

SEQ ID NO: 260256 - DNA, 677 bp, Homo sapiens
gaaacatagagctgcatctctaatggaagttttagtacaagtttatatatttctttggtgtggcttcataacaaataatatgaagcaatcagactaatttaggctgctttttgacccacattctttgactttacaagatagttcttatactttactcaagttttttccttttaccacaaaactgttttgttggttattaccaaggaatgacctgtgttgaataattatgatttaagggttctgctgagacatttttgcaattttaaattgctaaaatctgaacacctacttttataatccactcaccttcatgtggattctattctattttgctacatattgaaatagaccacattaaaaggttaagagtcttccctgtttctttgtggtggtcactgataaggacacctgtatttcatatggtcaatgaaagcagtaaatgaagttcagttctggaaaggccatctcactgatgatttatgatatctggaagcacggagtccctaatttaggtcaaaacattagtgaaatttttaccactgtaaccaaaaatttattttctaatattcttttttagctttgaaagtcattacaaagatgcttacttgacaaaaagtggcaagaggacatcattttatattttaagagaagattaggttgctaattatcttgaagag

SEQ ID NO: 260257 - DNA, 366 bp, Homo sapiens
cgggacaaatctgacccagggaccgccccccccatcttcaggatccagggccctagagctctgggtggggggcagtgctaaggaagtccaggggtcctggaagaagcatggtctttagcctaaactaaacctgggagtgaatcccggccctgtcatttggggctccctgaatgccatatcccatctttctgaactcgtttcttcacacgtcttggggatgatgctgactttcatgctgatgcataggtgaggggatcaccttggctcataacccttaaccttgtagctgagcagctttgcttcaaaatgcattctgaaacttttttttgctttctcttttcttactagtctcaagcagactgcaga

SEQ ID NO: 260258 - DNA, 653 bp, Homo sapiens
caaatctttcctgacgtggttttgaaaccccacccttcgaactttcaaattatatattactgaaacagtcatgcagtcccgctggagactggatccaggttctgccactaactagctgtgtaaccagtcataatttaattaatcataccagcttggcaaatctttaacaatttagtttatcatctatgtcctttagtttcttttcatggaatgtgaatttacagacatacctcagaagtattgcgggttcagatccccaccactgcaataaagcaaatatcacagtaaggtgaatcacatgaatttcttggtttcccaatgcaaataaaagttatttttccactatactgcagtctattaagtgtacaataagattatgtctgagaaaataacagaaatactttaattaaaaatatcttaatgctagaaaatgctaatgatcatctgagccttcagggagtcataatcttttagctggtacaggccttgcctcaatattgatggctgctgaataatcagggtggtgtttgctaaaggttgtgatggctgtgacaatttcttaaaataagacaacaatgatgtttgcctcgtcaattgactgtttcttttacaaaagactcctctgtagcatgtgatgctgtttgatagcattt

SEQ ID NO: 260259 - DNA, 1944 bp, Homo sapiens
aacattttctggaattatttttccctaatatttttgatcctttgctgatgaaatccatggatatggaaaccacaggtacagaacccatgggtatggagggctgactgtattttttcttcattgtagggggttaattaatgccccagttgtgtcattctcatgcagagttagagaaaatggacaaagatatttcaaagcaaagaagtctagtaatgttacagaagatctggcagcacttgtcttccttgatggcttctttggatggcatccttcatttactgcgacagccgttcttcgcctttcaaacacttcagaattccctgacagattcctacaaagattccttcagctagggtggagcctgatgtttggttttctggggttcccgtggaatttcactgcacatctggaggcttatgccctggggagcatccagtacttctcccccaagctgggtgccaggcctcaggcagctggattcacccaggagcagattggacaagccatccatttacttgttcactaactatccagcactctggatgttgcaggcactgttctaggtgctagggaacaccctagtgtatgtatctgaccatgtacccgtgctctttttttttttttgacacagtcttgctctgtcgcccaggctggagtgcagtggcaccatctcggctcactgcaacctctgccttcaggttcaagcaattcttatgccccagcctcccgagtggctgggactacaggtgtgcaccaccacatccggctaatctttgtatttttagtagaggtggggtttcaccatgttggccaggctggtcttgaactcctgacctcaatcaatctgccaccttggcctcccaaagtggtgggattactggcacaagctaccactcccagcctacccgtgttcttatatctgatcatttctgtctgagtgtgtgtcatctattatttggtatttttgtttgtttgtttcttgaatttcttttattcagttaaagagatttcatcatcctataagacccctcaggtgtgagggggagcagagagagctggagaaacaaaacacattagccctgtggaaaatcacatgatttctaagaaagtaatggttatgattcttaggctttctctataggaagtgtttcattgtcattgttttgttaggttggtcagctcagaggtgctgaaggcagtgcttacatttttgcagcaggtatatatcgcagtgtggattgaaccaggggcttcctgctggccttgtattcttagtttgttaaagcaaatggcctctccaagtcacttcccactgaaactaaatcccagaggaagcggaatgaacatggttagaaaccacaccaggaacccacagaatacccacaccaggcttgatggattgctgtgaaacagacctggcagggacccatcaggacaggctatggctttctggaggcaatagtgtattctcccagccttactaaggctgttagctgcccctaaggtctttggagtagatgccccatttggtaggtgttccttggaatccgtagctctggcagccacaagtcacaaagggaggagcaaatcaagggacattacagagcaggaactatgtggaaagggatgaaaaaccaaaccggccccttccaagtctgcagccacccacccatcattttaaaatgagtggactcaggcacagcaaaatgaaaggaaagtcagcagacccaggacttaaacccaagaatcctcatgtctagtgcagtgcttttcccgtcctgtccacggaggagaagcctcttccacaacccatggaaccatctcaacagtttgagaaactgaggctcaatatttttcttcacccaaatagctggaccgttgattctggaaactgtgttacctgtttgtctccctgcagcataatataactgtgtgtgtacattc

SEQ ID NO: 260260 - DNA, 229 bp, Homo sapiens
ttcctgtttttttaaacttttccgtaattccatcttctatgagttactgaatcattttttctacccttactgataagaatacaaacaaaatatctgtttcataaaaatgaatccgtatttcaaatttgaaagccacatttacttttcctttaaaactacatgaactactttcagatctcttatctgtgccagccagcttgttgtttaccttctcacaaatgtgcctgag

SEQ ID NO: 260261 - DNA, 2290 bp, Homo sapiens
gaattccctcttaactcttgaagtaaataaataatctttgctggcaggactatgctgaatctccttaggcactctctaattagatgtcctaggtcctcccaattcttagtccttttatacctgtttttctccttctcttattccatttagtttttcaattcatacaaaactgtatccaggccatcacctatcattctatacaacaaatgtttcttctaacatccccacaatatcaccccttaccacaagacctcccttcagcttaatctctcccactctaggttcccacgctgcccctaatcccgcttgaagcagccctgagaaacatcgcccattctctctccataccaccccccaaaaattttcgccaccccaacacttcaacactattttatttttcttattaatataagaaggcaggcatgtcaggcctctgagcccaagccaagccatcgcaacccctgtgacttgcacctatacgcccagatggcctgaagtaactgaagaatcacaaaagaagtgaatatgccttgccccaccttaactgatgacattccaccacaaaagaagtgtaaatggccggtccttgccttaactgatgacattaccttgtgaaagtcctcttcctggctcatcctggctcaaaaagcacccccactgagcaccttgagacccccactcctgcccgccagagaacaaaccccctttgactgtaattttcctttacctacccaaatcctataaaacggccccacccttatctcccttcactgactctcttttcggactcagcccgcctgcacccaggtgaaataaacagctttattgctcacacaaagcctgtttggtggtctcttcacacggacgcacatgaaatttagttgtatccataaggcatatggaggagactaattcctcttccaaagacatgtaccagagtcctggagaggctgagggctggaggtggaagaaaggctctgacaggggtcagaatctgttcaggaaacatagcaaatgcctgatacttttaattagagaaaggtttgaatctccacattcatatatttgcagtccagtgacctttcagtttttttatgcccaaagtgtcaagcatgttaatgttaccattgactgcctccctgaaggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctacctcgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagatactgtcttgaatactattcctggtttctgaagaatgcaacatatatctgtcagagggtgaaaagggtgtcccactcgcacaccttaaagcaaaagtgccttgagaatatctgcaagtctgtgtgaggccttgaaaataacactagggcataacaattacttcaggggatacgccatccaccctggctcttgtcccaagtgggctacatttgaagaattcacccaggctccagctagatcatcagttaatttaaagtggttattcttggaagtagcattttttttccctctcctgtgaatctgtgcaaaacattgaaggtagaagttttcttgttaaaaaaaaaggaattc

SEQ ID NO: 260262 - DNA, 706 bp, Homo sapiens
caccgtggtagccaagacagtcttgacctcctaacctcgtgatccacccacctcgtcctcccaaagtgctaggattacaggcatgagccaccgcatgcggcctccataaactttttttaaacatcaatgatttgaccattgttccactcaaacattaccataaatttgatgttcattcttgcttcaattttagcagaattcatgttactgagagaggtgctcctttcaaactgatgtcttgcccttcttagtgcctcaaactagatgcccttcagacatgttataacaagttagtatgagttttttttggtgcaaacatcttttaaatcaatgcatagtttttttgtaatatgcattttctatgaaatttttgaggtcccctcataattatctcatggcatctttctatcttaatgaactaggaggtttgtgagtgtgagacctatgacttacagtccaaatgttccctttgtgattagtacaacacctggcacattataagcattataatattttcagagaataaagagtttagcttaaaaatatatcttttttcctttgataacaagcatttactctaaaaaagaaatgtgttccctcctgacattgaaatggtgttttgttgaagcagcagccagttgagaaatacaaaaagtgggtaacatcttcattttgatgtgtgtatgtctgtagtaaattgtcattt

SEQ ID NO: 260263 - DNA, 431 bp, Homo sapiens
agcactataggatgactatagttaatgatatattagtttcaaatagttagaaggatactgagtgttcccaacacaaaagaatgataaatgttttaagatgacggatatgttaattaccctgatctgatcactatacatggtgtgtatagaaacatcactatgtaccctataaatatgtaaattattatgtgttagttaaaaaacaacaataaatatttagtaaagatgatatggttttgttgtgttcccacccaaaatctcatcttgaattgtaatctccataatccttataatccctgagtgtcaaggatgggaccaggtggaagtaattggaacatggggatggtttcccccatgctgttctctttatagagagtgagttcttatgagatctgatggttttataagtgtctggcatttcccctgcttgc

SEQ ID NO: 260264 - DNA, 384 bp, Homo sapiens
agcctcccaaagtgctaggattacaggcatgagccacttgcctggacaagaccctgtctaaaaaaaaaaaaaaagacaaagttgcagtcagtttggagccccccatgcttcctgtagtggatgatgagacctctgcttttttgctacacatgatgtgatctaatataaatcacatagtcgttctgcattaatttttttcacttgtacatttcagtaataatgtgattgaagaatgctacccttttgtgtctgcggccaaattgatttttgacaagggtgccaggaccattcaatggggaaaggatggtctctcaataaatagtattgggaaaactggatatccacgtgaaaagaatgaagttggagctgaggagtgggagagga

SEQ ID NO: 260265 - DNA, 401 bp, Homo sapiens
ttaatgctgaattataattgtatttctctagaaaccaatatgcaatgcttgtcaaccctgtgggagtgttttcagtcaaggttttctagtttctgagtcctcaccaacaaacctgttaggtggagatgtgttatacaatgtaaagagagaagcatttttatttccctggccttagacttcctcctttccctaatggaaattcatcttgattttaaatcctctgaagaggaagcaacccttaaagatgtctcaactcatctcccagcctcacatgccaatgagattgaattgctactgtgtgtggagcctgtagttattgcctggaaaagaataaatctttcctgatagtagctcagtatgccctctcacaaaatgcagagcaagaaattaaacctgagaaa

SEQ ID NO: 260266 - DNA, 396 bp, Homo sapiens
cacatgactacaaaatgtgttacatgcattaaaggaagtaacataatatataacagaacacaaaggtaagggcaaataatcttaggaagatcagggaaagcctcacagaggacaattgagatagttcttgaaggataagcaggtgatccccaggataagcggagtaagggaattcacggcagaggaacaacatgcacaaaggcaaaaaagaagaaaatcataaggtgggtgcaaagaattaattatgacaacaaaagcttatagccactgaacacttcctatgttacaggaactgtactgagtgctctatatacatcatctcacttcatccactcagcaaaatagaattatcttcacttttcaaataaggaaactgaggcttagcaaagttaaaaa

SEQ ID NO: 260267 - DNA, 470 bp, Homo sapiens
gacatgctttttaaaattcaccgtcttagcagcaatttgagtttgctcgatgattttatttttgcagggtgacttggagtggattcactgtctttgtaatgaatgcccttgcagttattttttatggttgtaataactcaatatgaatttaaaaaccttttctcaggaaaacacttttgtgttacatgtattataaattttgttctgttaatatttttttgtcaaacaattgtgtgtatatgtgtatgtgtgacacagagagagagagggagagagagagagatgtacatgtacttataagctggaaggacatgtatcaaaataacaaagagttacctctggttattacccccaaccctttttcatataaaaattaattattattcagtgcttcctttagtggttaaatacaacttcagtgcttttttttttcatctttgtatatttttgtattctctacaatataaaag

SEQ ID NO: 260268 - DNA, 836 bp, Homo sapiens
gggcagggcccccagggaggacagccacgggagctcaggcagcgtccccgccggcacctgcctctttgtgcagcggcagtcagggccctcggcaatgagctgaactcgcagtgcggttacgagggcaaatatgctccttgagggccggcgaaactcagcagcccgaggaaggctactgatgtgcatttcatagccggctgcgaatttaggaaaacagactttgcttctcgtcactcagcctacgtgaccaggttcagacacagtctgcagccgcccgcctcgcacccccactctgcagtgcggtatgtggggagctcagggcacagcaggccaggcctccccgtggacgtccaggaaccagaaccaaactgcccagggccccagaggggaagatgtctcagcagacggacagccgaggctcacatggcaagctctggcagcctgtcggtcccaggagagagggggagatggcagacgggaaaagaagccacctgctgggatgctgagactcgcttgcaggagcttttggaactggctgaggtcacagctggaaccactgtggccagctggagtctgcacagcccgagtttccaccccagggtcccagtaactccgcccaaatgtgcacacgagacctatgaggagacataactttccagaacccccttttcttccaccagccacttactcatccaagaacccacccccgaaccttccctaatagaaacactgcattaaagccagcgcggggagacagacgtgaactgcgcccctgtctccttgtgggttggcctagaataaaagcttttcttttctcaaaaaaaaatggtgtcata

SEQ ID NO: 260269 - DNA, 444 bp, Homo sapiens
gcttgaaatgcatatgcatagtactttccattagttacagaaaatgccaatattctttacttgaaaatgggacaaggaaagcaacagagtttgagggcctaaatcccacttatgccagccctgagtacttcctatatgcttgtggtcaagcccagcctcatctctcccagcttctcttcacacactggaagcctcacccaatccaaaccctgccaccctaccctttctcacttctgtgagcagctaggtggccgagtggtgagcgtgtcctaaatattcatccagagccgagtttgaattctggctctgcaatttattgtcactagtataacctcgggcatgtctataataatacctacctatgaggattgtcatgaggtttcaatgaaatcatgtatatgatgtgtttaacatagtgcctggcccataatacgcacttaaagt

SEQ ID NO: 260270 - DNA, 413 bp, Homo sapiens
ttcccatgcctatttacttctctacatactagaatatagtacccccgttgtcccgttttctctttcaaagcctctcttgcaactaggagtatccagcatatgaggggaatctgctgagacaatctgggaaagacttacctcactgacaagaagaaagcacttttcaaaacaggctgtttctacctgaatatgattgtgaggaagcatgatgtctagagcttgcagccatgataggggtaccaaacgagctgcagagacagtgatccagagccctgacattgtgaagctgctgaactaaccagccctgggctcacccacctctagaattcttgtaagataattacatgtccagagctttttcaagcacccatatctgtaaaaaaaagtttttaaataaagtttcttttgttgta

SEQ ID NO: 260271 - DNA, 527 bp, Homo sapiens
cactgtgaccttgaccaagtacattccattgtggacctccgatacaatgacggagttggaacagaccactctgcttattttaagtaaccaaatcattttcggaaaagaaaaaagatcttatggaaaaaccccgtacataaaagagataatagcagtactgccttcccttggccatctgaccgctctaacatccttctgcagaaccttaggctctgaagagtttgtagacttccagcaaggaccacgcatgcgcaagacagcaagtccggcgcatctgagagcagcagaacagggccacgcgaaaagctccttcggatctaccagaaagctccttccttggcatttgggagaagagtgggtcataataaaatgtccggtttctttggaaaagttatattccagtctcaaactattaccttttgaaaggacatttattagagttttttctcattataacagtaatatacgttcattgtagactctttggacagtatgggaaagtataaagaagacatctaaaaaccgta

SEQ ID NO: 260272 - DNA, 474 bp, Homo sapiens
caggatgccgctgatggagtacgacgagccggccgaatccgtgctcaccgaggacacctgcgtcacggagccagtggacactgcgcggagaaagacgggcggtcagggccgcagagggctgagggcggcggaccggctgtcaccgcacaaccttaggctctgaagagtttgtagacttccagcaaggaccacgcatgcgcaagacagcaagtccggcgcatctgagagcagcagaacagggccacgcgaaaagctccttcggatctaccagaaagctccttccttggcatttgggagaagagtgggtcataataaaatgtccggtttctttggaaaagttatattccagtctcaaactattaccttttgaaaggacatttattagagttttttctcattataacagtaatatacgttcattgtagactctttggacagtatgggaaagtataaagaagacatctaaaaaccgta

SEQ ID NO: 260273 - DNA, 523 bp, Homo sapiens
ctcaacggccaaacgtgtgtcccagaacaacatctgaggcggctaagagctcaaaagggctccaggagaacaagcacaagggtcagttgttgtccaagcgtgagcaactttcattcacgccctgctatacgctagatgctagtatgtagtctttaataatgatagaggaagatagagtgtctgatcttgagaagccagtaaatcgctaaggtagcatatcgggaaatagccacttcaatcctggctggaaagtagagagcaaaggccaggagagaggagtgtactaggaaggtaaacaagcacagatggtagaaaaaattatactgcacgcagaggaatgtggacttcattccacataagtgagtaacatcatgtaccaataagaagagaaactgggtggctggaaacatgaatataatggaaagttttcatttgtatacttaagctttttgaattttgaactgtgaaaagtattacttgttcaaaaaattcaaaaataaaattatttaaaaatccaatgcaa

SEQ ID NO: 260274 - DNA, 2604 bp, Homo sapiens
  misc_feature (387)..(387): n is a, c, g, or t
  misc_feature (2597)..(2603): n is a, c, g, or t
attctctttcctgtgaacctccagaacaatttgcttgaacttctcttgtagaacaaaccttattccagcatctatcagagacaataagggtcttagaatctagaaaacagggtcctgggagggcacagttcccacacgtctatttcttccacaggacctgcacgctgccttgctgttggagatctgtgcagtaggcagttgtggaattaaaagcaacaccccatgtcgctgaatgttcagggatcacaggccactgccgtttcccacccactcccagcctccggggagtcttagcctgtggagtcccaggaagcacatggaaaagagagccttggaaccagagtggagtgacagctaaggggtgctggaggcccctgtgaccttgancatgcacaatgcccagaccagctccgactttttcctctccttcacatatttaaatggagtcgatattggggtcagcttcatgcacggagccttcttcagctttagaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttggggtgccctcacccttcctcaaggcgtggccagaggcgtcagaaactccctcagtgcccctttgcgagtacttctcaagggaatggtccctgcccgaggcctgggggtagtctgaggggcccccaagtgtggagatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggctactgggaaataaatggccagcagaaagaagaaaaaaaaatctaatcccttgggtgatctgtgctctgaatgattgaaggtggggcagtccagctgaggagataagacccaaattaacccatataaagggtgggagaatgtctatggctttgacatgacctgcatccgggacgtggccatgaaggagcctctagtggacatcgtggatccaaagcaagtggtgaccaatgcctgtttgataaagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaaannnnnnna

SEQ ID NO: 260275 - DNA, 365 bp, Homo sapiens
gatggctcagctgctgtctgtgggcttcacttccactcatgacatccagagtttcctctggttccagcccattttatgcaaggattccactttcttcatgagagcctaaaatgtgtcaatctagtgtaaacactttcccttctgcacagaggagaatctggctactgggaaataaatggccagcagaaagaagaaaaaaaaatctaatcccttgggtgatctgtgctctgaatgattgaaggtggggcagtccagctgaggagataagacccaaattaacccatataaaggtaactaaaacaccaggcattgcaaaacagtgcaggcattaaatgtttgggaatgaatctcaattcaaaaaacat

SEQ ID NO: 260276 - DNA, 2375 bp, Homo sapiens
  misc_feature (2368)..(2374): n is a, c, g, or t
agttggcggctgcctccggccggccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaaannnnnnna

SEQ ID NO: 260277 - DNA, 7931 bp, Homo sapiens
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcaggctggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgaccccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctaagggtcatcagccgggccccgggcctcaagctggtggtggagacgctgatatcgtcgctcaggcccattgggaacatcgtcctcatctgctgcgccttcttcatcatttttggcatcttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggatgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccactggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcactgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggacgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccatccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctccccctccg

SEQ ID NO: 260278 - DNA, 490 bp, Homo sapiens
atagagctttgggttttgcaaaagggagggtctgacaacacatcccctggttgcatgtttgctgaaatagataatcctaagaagacttaggtggggtttcctgaaattgagggcatggaaatagaggaaaggggtaggattatggaggggaagggaggcaggcgtcttcctgtcagcctagtagacaccatgaaggtagccaggcgagggccatcttgaaaaggtcccacccaagtgctttccagggtgtattagtctgctaggggtgccataacaaagcgccacagattgggtggcttaaataatagaaacttattttctcataatcctggaggctgcatgttcaagatcatgatgttagcagggttggtttattctgaggcagctctccttggcttcttgacagccaactccctgtcttcaaacggtcttccctctgtgcatgtctgcatcctgatctccccttcttataaggacatcagtcatattg

SEQ ID NO: 260279 - DNA, 675 bp, Homo sapiens
aaaaaaatgatactttccaggttcgcttgggtccagatctgtattcccagggctcatagagatattggcaaactgacagatttcatggctcaagaaacctaaagacacctacttgaattcctttggttggcagtcaaatgttaactagtgtgttttcaagcttctattcttaggcatgttacttccttttggaagtcaaaaccaaccatcttttaagtaagagggctaaccaaatatgtgccacactaaagcaaacaaattcacaaaagagcgcttataattcccttaatgtttgacttgggggaagttgacctcaataactagaaaaccaaataattctgagcaaatatcaaatattgtcttatgcataatcaaaagattcagtgagaatcagctgaaggagttttaagacattctcagaggaagtgctataagtcagttctagtttagaaatagctagttttgatagatcttacttcagtctcaaaaattattagttagtcattaatgatgcttctatgggtttctctacattattttcccaacaaatacatgtaagtttcctgggtaagagtcacactacaagtgtctgattcctctcaacttgtggtgcaagactgatgtattatattatgatgtatttattatcatgtataataaacatgaaagaaccca

SEQ ID NO: 260280 - DNA, 663 bp, Homo sapiens
agagagccaaaccatctcacaaagtatcttctgaatgttttgccagtattatggtctgtggagaatgtgtctatgtccactttgagcccccagtgggaaatgggagtgcagatcttccctgaggctgtgaagtgggggcagcagtggcctagggagggtaggtggcaccaaaactgcactgagtagcagcctggctaaggctggtgaacaccaccaagctgaactgcagcatgcagactcccagaggggtgagtcatttgagggagagctgctgagaaagggggctgaggcctctaccagaattcagcaaggcagaggaggcactcagggaaacccattacaactcttatgtcatatatcgtaatttttaacaagtattttttttaacaaaaacaggatcacaatacactgttctgaaatattctttggcatgaagcagcatactggcaatgttttctatattactaaatggagaatatttagtaataaccctgctcaataatattctataaaaccacatagtggttttataagtcgcatgccggttactttcctaattgcgccatatcacaggaggctccatttcccaggctccctgtgccaacacacttcctgctaggttcaaccaatggaaacactgcagaaaatgagtgggcgggagga

SEQ ID NO: 260281 - DNA, 217 bp, Homo sapiens
tcttattaatttaatagtttctaaagagaaatttcattaacaaattaacaggaacagctacaaaatttgcagtgttcagtgcaaaattaacatataggacatcttactcaaaaattatttaaaacttgatacgaatgacaccaaagaattagccaagtgatgggcccctgcaaatgagcagatcacataaatctatccctgaacatcaattagttat

SEQ ID NO: 260282 - DNA, 556 bp, Homo sapiens
gcaacttagattggcagctgttaagcaaattggaggtctgaagagcaattttctggcaatatcaagattagctattaatatgtattaacagactgtaaaggattcatggaatttcactttgagaactgatgattgagcgtcgcttttacatgagcgggttctgcagtgaacgccaaacacatttgtcatctgtgtggtgccataacattcctatgaaatagaaaaaccatctttgctaccttccatcaacctcagaggagtattttgacaacacatgtagatttatgatcaatggaaattataaaactaaaaagaagtgagtgacccattttattatccagaatagggaacgtgggataggtccccctgggctggcctgatttcagagctcattaaagaaaagtgaggcaagaactgggaaaagtctttgcatttttttctttaaaggccagtgaccctactaaaactaagtggtagaaactaaatacattgatttcaggatacaatttttacagaaaatcagtgtctccctgatctcattcaataaatactgaac

SEQ ID NO: 260283 - DNA, 430 bp, Homo sapiens
attggctttcctttcttttttctttttttctgttttcttcaaataggaaattccttgatattttaaagcatatctgtgtatcttgaccaaagtattgtgtgaaaaacatttttattacaaagatttagctaacattttaaatataatgaaaaaatatttcctcaaaattgggttgggggattggcctgaaaacttacatctcaacaagaagaggtgtacagtaagagcataacaaataaaatatcttaatttgatcacttaagattttcttcttttttttttaaattttttttgagatggagtctcactctgtcacccaggccaggaaatcacttgaacccgggaggcgaagtttgcagtgagccaagattgtgccactgcactccagcctgggcaacagggcgagactctgtcaagagaaaaaaaaaaa

SEQ ID NO: 260284 - DNA, 659 bp, Homo sapiens
gggatattattccctcaacactgggaggattggcatccctttaggaccacagctcctgccgagtgcccttcatccacagctgtgtctctccccagaatctgggatctttgtctctctttactcctttaggctaggggtagtaatggctccctggtatttctagtcccagggtgtttcatcagctcttaggcattccccactgacctctgtgtatgcctctgtcaatagaacaattaaactccttcacttgaaacctttaaatgtgcatctgcttcctgccagaaccctgtaatgaataacagttctatgattttattcctgttttacagataaaaaaatggggactcaggagtccaaatgacctgcctttaaaaagtcactggtagcaaagggtgaagctgctttgagaccatgttttcctgatccaggttttgtaattgatcaactcaatcccttgatgcccaccaatccctactggacatcaagagtgagagtcacaagcagatgtctctcaaatgggaactggctgtcacatatggttagtttgatttgttccaggttttaaaaatcagagaatttcacagaattctagattttttacttctactgaaaaaccagaaaatctggaagcaatgacattatattcttttgtggagtca

SEQ ID NO: 260285 - DNA, 655 bp, Homo sapiens
ctcagtgaaaactttctaaactttaaaataagccatctatactctcaaacctgctgttttggtcacaaagcttcatctgttgttttgtttctgttcggggctgatttgaatgaactgatgaacttaactaaacacagcagagaattgctcaatccctttttactttcttgctaattaaattttgaatgtctgctgtggaaaagggaggtgggaagattttagaactccaattaattgcagatgcttaatcacaccagctgaaagctggcaagccaccccataatttacatagtctgtccactggacagctgtggctgggaatgggcagggatgggtggggtgcaagccccttcaccccagtgctggcgtcgtagtgcttgccataacagacatttgtgaaaacctttcaccctccccattgctgtcttcacttttcctggcctctgtatattcctctgatgcatttcttagggtccttaagcctccttggctattttgcaattcagtacgtttgttgtaggtgtggctcaaaattaaagagtagagacagaaagacaaggatggatcaagttggtttttttttcctttgtagtcctttaaatactaatttttttttttttttttacctaaataattgtcagaatcttcagaaagg

SEQ ID NO: 260286 - DNA, 906 bp, Homo sapiens
aggattggtcaacaggaagctggtggtcagttaggcaatcatgtccagggagggatctggtgtctcactgtccagaggcagtgaactggtgagtttcagttccataatactatctggggagcttgctggttggtttcctgagaaaggaactcagataagacaaacgtcactttctcaagttttaagactggaaaggtcaatttctatgtttatccaaaataaaccataaacatcagttctatgagacaattgcgccagtttcacttccagcacagaagcctcaatttatttttttgccataaataccaaagaagttataagacactaagtgctgaaaggcaactagaagaaggtgtgcttttcaaaagttgactattatttagcagttttaggttaatggcaaaattaaatggaaagtagagattttccatggaccctgcctcccacatgtgctcagcctccccaacatcttgcattggggtggtacatttgttacaactgatgaacctaaagggatatgtggttgtgtttatttttcaatggatgaaactcacatataacaatgatcgccaaaatacaaaattgacatttaatctttaggatgtttgactaatctgtttctcccattctaacattggcttttaatctttaaggaaccagagagaaaagaaatatgacccaagctgcttctgaaagtctggggaacaactggtacactacagaggctcacatcaggagaagaaaaaatcccttcagctactggagtctgagctactttggggtactctttcttccaacttttccccttcctaacccactcctcccagaacacaaagaagaccagacagatggctgaactcctcacacccaattggaccaatccacgctgcacacacgaccaatcca

SEQ ID NO: 260287 - DNA, 447 bp, Homo sapiens
taattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaactaggaaatctgtactcatgatagtacttactaaatgaaaattcaagtgaagcccaggtctgaaaaatacttgagcagaggaaagcaaaaacctttaaagtaattaatcttgcttaagctgcaaacataaatgaaacttcacttgggtcatt

SEQ ID NO: 260288 - DNA, 422 bp, Homo sapiens
cctaaccctgccgcaactaagactgctcttaaccatccagttaaagagagaaagggcagagttttatagtcagctgttgaatatttctgctgagaaataataactcactattttgcccaggccagtcttgaactcctgggctcaagcaatcctcccacgtcagtccccaaagtgctgggattatgggtgtgagccactgcgcccggcccagatggacttctcaatcttcttgttatttcctaaacttagaagtggggcccatgggtttgacacccctgccagggtttctggggagcttcaggcaggcctgtggcctgaacgctgtcctgtacttcacctgcacccagagtccctgactcccacccaagttccctgtgtcccccccacactccttccatgcttctctgaggcacaccagccat

SEQ ID NO: 260289 - DNA, 671 bp, Homo sapiens
gggaaagtccctaccatggttatctccagcaagggccaaataagtccccttcggggtcagaggagcccaaccacaaggccagaagcagccagtgtagccactgtctttttttgctgtcagtgggcagcatctctaggacttattttcccagggactcccttgcctgctcatttctggctgtctgcctattctaacacccccatgactcttatcacatagctgaacataaggacaaggctaagcaaaatcttctgctcttgctttcaattttccttgggaaacaaaggaaaatcatggcaaagctacatgattaattgctaagtataccgagcagaaactagagagctttaggagcccaaagacccacggacactggaaaatataaggggaacatttttcaacagtctactacatggatttaagggtaaaatgatataatgtttggggtttgcttaaaaactctccaaaaacataaaaagcgggaggactgatgtaacaagattggcaaaatgttgctagctattaaagctgggtcttaggtacctagaagtttataatgttctctactttggaatatatctgaaatttttcattataaaagggtagatttttacatacactgtgtatgatgcccatcttaaacatttggcacgttatattgtttaatcttt

SEQ ID NO: 260290 - DNA, 2890 bp, Homo sapiens
atggagccgggaaagggaagagctcagcggacaaggcaagtgctgcttttctttgttttcctgggagggtctttggtgtgttctgagaccgggagctattccatagcagaggaaatggaggtcggtacctttatagccaacgtggtgaaagacatgggtttggatgtggaagacctggctgcaagggggggccagagtcatctttgacgactataaaccttatttgcgattggatccacagaatggcgacttgctcttaaacgagcagctggaccgggaggcactttgtgatctcacagagccatgtatattgcatttccaggtgttatttgaaaatccgttgcaattttttcgtgctgagcttttggtcaaagacataaatgatcacactcccacgttcctaaacaatcatatgcttctaaaaatctccgaaggtgctactctaggaaccttattccaaatagatagtgcgcaggacttggatgtgggaaagaatggtgttcaaaactatacaataagtcccaatccccatttccaccttaaattacgggatagcgatgagggcagaaaatatccagagttggtactggaccaatccctggatcgagaaaaggtgtctgagtttagtttaacgctaacagccgtggatggcgggtctccgcccaggtctgggactacactgattaacgttgtggtcctggacatcagtgacaatgcccctgaatttgagaagccagtctatgaagttcatgtacctgagagcagccctctggactccttgatcatcaaagcgtctgctacagatttagatgcaggaataaatggagaactgtcttattcattttcccacgtctccagagatgtacggaaaacatttgaaatccatccaatttctggcgaagtctatttaaaagcccctctagatttcgagattattcaatcttatatcataaatattcaggccattgaaggtgggagcctttctggaaaatcaagcattttagttcgggttgtagatgtgaatgacaacccgccagaaatagccatgacatctcttaccagccccataccggaaaactcttcacctgagatggtggtcgctgttttcagcatacgagaccaagacgctggagacaatgggagaacagtttgctcaattcaggacaacctcccctttgtcttgaagcctaccttcaagaatttttacgctctggtaacagagcacccactggacagagaggtcagaaatgaatataacatcaccatcaccgtgaccgacttggggacacccaggctgaaaaccgagcacaacataaccgtgctggtctccgacgtcaatgacaacgcccccatcttcacccaaacctcctacaccctgttcgtccgcgagaacaacagccccgccctgcacatcggcagcgtcagcgctacagacagagactcaggcaccaacgcccaggtcacctactcgctgctgccgccccaggacccgcacctgcccctcacctccctggtctccatcaacgcggacaacggccacctattcgccctcaggtctttggactacgaggccctgcaggagttcgggtttcgcgtgggcgccgcagaccacggctccccggcgctgagcagcgaggtgctggtgcgcgtgctggtgctggacgccaacgacaactcgcccttcgtgctgtacccgctgcagaacggctcggcgccctgcaccgagctggtacctcgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggggcgcaccgccaggctgctgagcgagcgcgacgcggccaagcacaggctggtggtgctggtcaaggacaatggcgagcctccgcgctcggccaccgccacgctgcacgtgctcctggtggagggcttctctcagccctacctgcctctcacggaggctgccccctcccaggcccaggccgactccctcaccgtctacctggtggtggcgttggcctcggtgtcgtcgctcttcctcttctcggtgttcctgttcgtggcggtgcggctgtgcaggaggagcagggcggcctcgatgggtcgctgctcggtgcccgagtgtccctttccagggcatctggtagacgtgagcggcaccgggaccctatcccagagctaccagtacgaggtgtgtctgacgggaggctcaggggcaaatgagttcaagttcctgaagccggtgattcccaatctcctgtcccgcgacagcgaaatggagaaagccccacctttctgaatggcgtggaatgcaattagggatctgattatgatgcagaacttttagaatgagtctatttctttgaaatcttattcattgttatgcagagtttttcattttgggtaactgcattttactcaagagttttcagaagttacaagaatttaagtctattttttgttgttttaaccgtgaaaaaattgagagccggaatttgcttagtcattgttttgaaatacaacctcaaataatatattcacaaacacattattttcccttcaagtttaatcgcacactgggctcattcatattttctgagtgttctgactgtggatcctctatccaaagcagtttttatataattgagaatattattatagaggtaaatgcatgatatgaataaaaacataattgcttgttatctggttaggttggtttctgagatgttatctaatttaggtttctttcttaaaaacctataatcttttcattctacttttctggcaaacattgcagagaatttttcctgtacttagggtt

SEQ ID NO: 260291 - DNA, 713 bp, Homo sapiens
agattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagta

SEQ ID NO: 260292 - DNA, 240 bp, Homo sapiens
ccatcacaatactgaaactactcatggtagttttctgtgacctaattgcaaattttagtggatgttttttatttcattcttccatttattcaaaaattagttgagcactttattccaggctcttggaaataaattggtgaacaaaatagtcacttatgttttcatgggcttacattttagaaggcaaaacagtaaacatgatgtgtaaattaactgttatgaaagagaaaaagtatagca

SEQ ID NO: 260293 - DNA, 329 bp, Homo sapiens
tggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaa

SEQ ID NO: 260294 - DNA, 382 bp, Homo sapiens
gatgaattgtactttggtgtgatatggggcatattaagctagcagaagttataaggcagatgtgcctactggcttttcacttgaatttataacagtggacttgaaagtttcgatctatttgtatctctcctctgctgtcacagaagtcccattttagccaacctgctgccttattttttaagatggagcctccttacacacacacacacacacacacacacacacacacacacacattaataaactaatacatgttcttttcaaacaaacttaaacagtgcagacatgctgcattagtttccatccaatagcttggcgtgggtgcctgggaacagctctacctcaggaggaaggtgctgggctttgtggctgcccttaacca

SEQ ID NO: 260295 - DNA, 360 bp, Homo sapiens
tctcacgccggaatgcccgataacaagaccgtcccgagagactccgcaaaagccacaaccttgcacactggctaggcaacctcacaccgaaaaataccggaggactcccgccagcggcgcccgtccgacctccggcgggcggcgccctctcacccgtcctcctggccgcaaaatgaccgcaaacagggacgccgccctctcatcccaccgccaccccggctgcgctcagcggccgcgcacccccacgtttgccagcagctcccagaggcggtcagcctttgggtttgacgacggcaacttcccgggcctcggcgagcgcagccacgcacccggaagccgcctcggggcgcgacgccgagc

SEQ ID NO: 260296 - DNA, 365 bp, Homo sapiens
tttatagaaaatttggatataggaaaggtcaaaggcctataaattctgccactagagcagtttttctcagctatttttttcttctttttaaaccataacccattcaaaatatgtatatttacatttaaaaagtttcatgaaacagtgcttatctttactaggagcaatgctcccaatgctcccaatacttccaattaaattcatttgatttcaagtatctaaattgatttcatgacccacaatttgaaaaacactgatctagagagaatttgttaacactatatgtatatatttgtttgtatgttctcttaatcacctatgtattaaatgttaaagcaattaaaattttaatattcatttgcctc

SEQ ID NO: 260297 - DNA, 468 bp, Homo sapiens
cctttaaaccttgctctacttgtccctggcagttgacaaaagagcctggccctgcacgtccctccctggcccccgcatccttccctttgatgtcagcaagactgatggttgagttgcctttcttgcagatgtacacttattcatgctctgagtagatgctaattgctagtgacaaaaatatgagtaagataggaattttggcccccagaatcttacttgtaaaacatatgggaacctgacatggaaaccacaggaatgtcaggcctccagggcaggaatttttgtctgtctattccctaatatttacctgtcccctaaaacagcaccagcacatggtaggtacttggtcaatatgagctgttaatgaatgatattgtatatgggctttatcattggctgggtttactctaactgttctctgtttttatgtttttattttgttctgttttgtttttcagatggagtctc

SEQ ID NO: 260298 - DNA, 694 bp, Homo sapiens
ggcttgtagatggataactgagttctacaggtagggatttgtctaggtcttaagcttgaggtaaccaaaagaggattagacttggattttcaagcctgtgtaaagcatgcactcataccctgtcctcagtgggatttggacatctttgctactggttgctggggggaagatgctgtgggtggaaaatggtatattagccaagtgactctcaatggaccattcatatattttctactccctagtaaatttatcttaacatattaagaaaacaaaatggttcgtaagtggttgtgcttttaaaatttatggatttagcaacattttacagatttcacttgtatgactgagttttcgctagttagatgaattgttaaaaatcttaaagaaacgaatgtatcctatagtaatataatttgaaaacaaattgtttttagtgttttgaatgaagcactgccaactcctcagcatagatcctcagacatacttttgagtaaggatgcgttattagaccctattactgaaaatatagttgaggctttaatatgtatattaatataaagcagaatgaaaattttcctctttttttttttgtattccattgtataaatataccacaatttatttcttctcctggtgacagtcatttcagttattttcagtttgggactcttatgaataaatctacgatgaatag

SEQ ID NO: 260299 - DNA, 724 bp, Homo sapiens
  misc_feature (70)..(70): n is a, c, g, or t
attaaggcttgttatgaagagaagtttaaagaaataaaggtatttatttcatcttggtatttgaatgggnaaactcccagtagggtaaaaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggccctgtctcaaaaaataaataaataggagtttgaggccatgttcacacatcactgcagtccagtctggtaaacagagcaagacgctgagtctttaacaaaaaaaaa

SEQ ID NO: 260300 - DNA, 1588 bp, Homo sapiens
tgctgaggccccaaaacagaaaggaaagctcaccaccagaatgtgccttttccttatcaaaaagaattgctgccccttacaggacaggaggactccaattgtgaccaagttggagcagccttgagccacaactcagacttattttcattctctgctcattggccattaggaacccgatccttatgacctgcagtgacctgctgctaccagaactgactcgcttcaaagtgacggatgaaacccatatggagatattcctggggtgggtaggccagttggaagacagagtgtttacacctgagagaggacttgagcatatctgaaccttttgcaccattcagtaaagagaaaaggggagctcagaattttactcagtcacgttgctcactgctgcgcactcctgcagacgcatcccagtggactctgcgctgcatccccagagtacagcgagtttcccgcctcccgttagagatccaacacatattttttttgaaagaagaaactgatggaagacaggaagcaaaaaggagaggaaggaaagggataggaaggaggggaaggaaagggaaaggaaggaaaagaaaggaaagtgaacttgaaatcctacaaggtctcaaagtcaaaaaacatgattgctgttttagagaattgaagatccttcatcttcaagaatctgaaatctaccatgatcttcacatgtagccaaacacaatgggatgtagtcatttaagagtgctgtgaaggcagtgaaaagcagttgaaataccattagttaacagattgcccaatgaagtcgatgacaactgtgataacaagttactcactatcacagcgtctccaagagatgaacagtggatgatgcttccaaagcacagatgtccctctcctcctcaaccttctctccccagaaagatgtcaacactgtggagattgtgctatgaagatacctggtgtggcattgcaatagatgaaatattaagggcaattcaacaattttctgaacaaatacatggatttaacttgaagttgaatttaatttgacttcaagaaaaattatatttctggtcctcctatgatcatgcactaagaattatttaactgcagatacaattgttacctttagagctagaaggcctcattttagaattaaaatgaatggcaacccagacagataaagtcgagtcgtgatcatcccactgcggaggcagagccagtgctggccatcccccgaccaccccaacacactccaggtctcacacatttaatctctctctctgccaagggaattttttctttccatttattcttagaaacaactaagggagttttaagttaaatacatgctgccaaattgaatccaaggaaactaaagtcaaatatattagcaaacacttaatgtcctctccattttgacatttctccctcaattcctatttctgagtaaaggctgttcagatgaataaaaacatattttcagaaatctgagctcataagacctataggtctgtgaagtcacagaccgtgcactgtcagcagtcagcaattctgctgggttgaattggcatgtttcaaactatgtatttttgtt

SEQ ID NO: 260301 - DNA, 894 bp, Homo sapiens
gtgagggttagtgattggttggggtttctattttaacgacggcggctgctgagggaaaagcagttgaaataccattagttaacagattgcccaatgaagtcgatgacaactgtgataacaagttactcactatcacagcgtctccaagagatgaacagtggatgatgcttccaaagcacagatgtccctctcctcctcaaccttctctccccagaaagatgtcaacactgtggagattgtgctatgaagatacctggtgtggcattgcaatagatgaaatattaagggcaattcaacaattttctgaacaaatacatggatttaacttgaagttgaatttaatttgacttcaagaaaaattatatttctggtcctcctatgatcatgcactaagaattatttaactgcagatacaattgttacctttagagctagaaggcctcattttagaattaaaatgaatggcaacccagacagataaagtcgagtcgtgatcatcccactgcggaggcagagccagtgctggccatcccccgaccaccccaacacactccaggtctcacacatttaatctctctctctgccaagggaattttttctttccatttattcttagaaacaactaagggagttttaagttaaatacatgctgccaaattgaatccaaggaaactaaagtcaaatatattagcaaacacttaatgtcctctccattttgacatttctccctcaattcctatttctgagtaaaggctgttcagatgaataaaaacatattttcagaaatctgagctcataagacctataggtctgtgaagtcacagaccgtgcactgtcagcagtcagcaattctgctgggttgaattggcatgtttcaaactatgtatttttgtt

SEQ ID NO: 260302 - DNA, 1079 bp, Homo sapiens
tcttgggaagcaaatgctgagttttggaatgttctgcctgggaagagtgtttttgtacggctgaggccttacgccacatggcaccggttgaacagcttgttaatgctagcaatgtgatttatgttgaatgcctaattctgctctggagaactggaatctgagtatctgagttcagccatataaatgcttcaggtctgcaggactggctcccaacaagaaccctggacacaaaggctcaggaaaagcagttgaaataccattagttaacagattgcccaatgaagtcgatgacaactgtgataacaagttactcactatcacagcgtctccaagagatgaacagtggatgatgcttccaaagcacagatgtccctctcctcctcaaccttctctccccagaaagatgtcaacactgtggagattgtgctatgaagatacctggtgtggcattgcaatagatgaaatattaagggcaattcaacaattttctgaacaaatacatggatttaacttgaagttgaatttaatttgacttcaagaaaaattatatttctggtcctcctatgatcatgcactaagaattatttaactgcagatacaattgttacctttagagctagaaggcctcattttagaattaaaatgaatggcaacccagacagataaagtcgagtcgtgatcatcccactgcggaggcagagccagtgctggccatcccccgaccaccccaacacactccaggtctcacacatttaatctctctctctgccaagggaattttttctttccatttattcttagaaacaactaagggagttttaagttaaatacatgctgccaaattgaatccaaggaaactaaagtcaaatatattagcaaacacttaatgtcctctccattttgacatttctccctcaattcctatttctgagtaaaggctgttcagatgaataaaaacatattttcagaaatctgagctcataagacctataggtctgtgaagtcacagaccgtgcactgtcagcagtcagcaattctgctgggttgaattggcatgtttcaaactatgtatttttgtt

SEQ ID NO: 260303 - DNA, 635 bp, Homo sapiens
tgctgaggccccaaaacagaaaggaaagctcaccaccagaatgtgccttttccttatcaaaaagaattgctgccccttacaggacaggaggactccaattgtgaccaagttggagcagccttgagccacaactcagacttattttcattctctgctcattggccattaggaacccgatccttatgacctgcagtgacctgctgctaccagaactgactcgcttcaaagtgacggatgaaacccatatggagatattcctggggtgggtaggccagttggaagacagagtgtttacacctgagagaggacttgagaattttactcagtcacgttgctcactgctgcgcactcctgcagacgcatcccagtggactctgcgctgcatccccagagtacagcgagtttcccgcctcccgttagagatccaacacatattttttttgaaagaagaaactgatggaagacaggaagcaaaaaggagaggaaggaaagggataggaaggaggggaaggaaagggaaaggaaggaaaagaaaggaaagtgaacttgaaatcctacaaggtctcaaagtcaaaaaacatgtaagtcaattatcacagaaaataaaagaactgctacaagggcaagttactggg

SEQ ID NO: 260304 - DNA, 547 bp, Homo sapiens
aagtcaccagagctacgggcagagcagtgaatccagtctaggtggaaaaatgactttaactcccatcaattttacatttccacttacacatgtgtgttcctttgatgataatgcagacagaattaaaatgttgtctatagtagtatttcttttaacatgaggaaattggtgtcattataaatttcttttgtgatgtgtagaatggaaatggagctccaactgaactattgcaggctaatgattatcctaccattgtaatttatatttgtataagaatctagactagcgttactccctacggcaaaccctgtctcagataaaaccactaatccattgatttttgttgttgttatctacttcatgttggtaatcttttttattcatcccattctctgattttcctgttcccaggatccaatgctcttacgtatacaccattctcagtcattttgttgatttatatcctcttctctattcagttttgaaaattctattttaagatgccaaatatgtatatatattcatttcccatttctttttctactac

SEQ ID NO: 260305 - DNA, 448 bp, Homo sapiens
aataactgtccagtagctggacaagagagactcataatatggcagttgaagccaaagcattaagcaaaaacagttattaatattaacaggctcactgtagagagaagccatagttgtcaggggaggcagaactgcccaggaaacccatctttgtccttttgtctacacaggttggggcaaaagcagcagttatttgaactcagcaaacctgtgttccatattgaaggcctgcataagtcagggaccagggatgtaatgaagaccagacatggactttaggagcacaaagtgtagagataaaactgcactcataatgtaagctaatgggaggcaggaacgatggaagcagcaaagactcgctacagtgggaggagttatgagagacttcccagaagatatggcatctgagctgattcttaaaagttctgtaagaggccaacaggcagag

SEQ ID NO: 260306 - DNA, 470 bp, Homo sapiens
tgatctgcccgcctcggcctcccaaagtgctgggatttacaggcgtgggccaccatgcctggcctgtttctggaaactttaaaacgataatctacctgggattgatttgtttgtatatgtctcttgctgtgtaattggataaggcttattttcattcgtggcatatagataaccaattgacctagcttcatgtattgaaaagaacttttttcctaactttgtcataaaacaagtgtctatatataaaagtgtgtgtatgtcttcgctattcatgcttgttttgcatttccatggaaagtttataatcaagcttgttaccccaaaaaatcaaaaaatccactgggattgtattgactcttaattactttttctttctttcttttttttttttttttttttgagacaagagctcattctgctgcccaggctggagtgcaaatggtgcaatctcagctcactgcaacctccac

SEQ ID NO: 260307 - DNA, 377 bp, Homo sapiens
ctgactcagttagcaacttcttagcatatcaatgtctcattttgtttctctggcaaaaagctcaaatattggattgcctgattcaaaactgacccctaggcaacctcagtttttccaggagagtacagtgaatatctgtttattcccattcctggaaagcagtaactgtcattttctgggctcacacagcctgcacatatagcctggttataattctttctctgagaaatgggggagccctgttaagacagccaagctggtctccagacttagagatccatgagccattgcttctaccgcatgaatcagtggaaatatcaacctccctgagatggtaaatgtcaagacctgtggataaatgttgaaaaatcagaaaa

SEQ ID NO: 260308 - DNA, 344 bp, Homo sapiens
tccttatttttggagtcatgcaaacatagtgagagactttgatgtagtgcatatccaacttctacatcttcacacacatatatattatacataaagattaaattttaaaatattttgactacatagaaatgccctagttctggcacactttcttggaataaaatgacccctttcaacttgtaagtgtaaaaatgttccaagtagtttcccattttcccttataacatccttttctcttggatgttaaggattatgctacagtaatataaacaataaaagaacatctatccagcatctaccaataaaataaacatttacccatcatctaccaataaagcatacat

SEQ ID NO: 260309 - DNA, 788 bp, Homo sapiens
atgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtctccaagtactttttaacccaatgggatgaacagcctgtggtctgctcagatcaccctgagtgcgtgtgagaaggcctggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaa

SEQ ID NO: 260310 - DNA, 548 bp, Homo sapiens
aatttccattaaaagtagaaattttaatttgaataataaacattaaggggttttactttaagacagaaatgggaaactctttcattattaaatacgaattacaaaaaatttacaggaacatcaacacaatttccagtaaagtatacgatagtcagagtgcactggttgaccatagaaaatatttttcaaatagctgaatgccaggtaaccttaaaaggaaaccagaaaaatgttatggcaggggaagctcatggttgaataaagctttaaatagataagaatataatagatcaatgatgattaccaaagaacataaattacactatgtggacaatgcacagaaaggcagatgaaaaccaagacaacaagagtaatgttaaggctacccgtgtatcactggattctgcatgaagatctgtggaacctgttacaagaaaatgtctattaaattcattgaatcaaagaatgttaagaaagtctagaaaggagttttgagtttctgagtccaaccctcatattttactgataaagacttggaagtggccgga

SEQ ID NO: 260311 - DNA, 875 bp, Homo sapiens
agacagtgtaaatgtgtgaaggcctgacacttacacatacattgcttttttctctatgtaaggtggcagttgctggagtaccagggcaccaagtggaggatgtggtagacagcctctaagatgcgccccctgccaatgatctctgcctccagggaggagctagaaggcagagagaaagccactcaggacttcccatcccagaagataaaggtgaggaaagcagcagcagcagccacaggccagtattccagagcagctttgggttcctgtcaagacctgctttgagaaggaggtggctgtggggctggagggctgggcctgttcctgagctggctgctggcagcacagcaatgaggcaacattgagaactgcgacacgaggcccagtcctgctactaaaccaactgtgtggacttgcatagtcacttcacccctcgggcctccatttctccactttggaaagcagtgttgggacgatgttaagggtttgcaaccttccaacatgaagacttatttttaaaagcaaaacatttcaaagagtccacatgacagtagtgttcattttggcatctgttgatttaacaaatacaaaattaggctgggtgtagttgctaacgcctgtaattccagcactttgggagaccgaggcaggaggatcacctgaaatcaggagttcgagaccagcctggccaacatggtggaactccatcactaccaaaaatacaaaaattagctgggcttggtggcacgtgcctgtaatcccagctactcgggaggctgaggcaggagaatcatttgaacccgggaggcagaggttgcagtgacctgagattgcaccactgtactccagcctgggcaacagggcaagactccatt

SEQ ID NO: 260312 - DNA, 527 bp, Homo sapiens
gagaatttatgcaagatgttttgcatgtgaccaagtttgttatgatcagaagaaaattaaattataagtctttctaaggactgagctttggcattaaaaatacactaataaaaaactgaaaaatgtggttccctatgttagaacaacaaggctttcttaaagtattgctttacttttcataaaattgcaagaggttttgagttttaattctgaaatctgttcccttaacagccatcttctaaactacagacaatttccatttctgtcaaatatttttctgagatctatttaatttgcccagtttgaggatggagattcagctccccttttttcttgcctaaaaaggcacaacatcttggctgaggtgatagcttttcttcaaccttttgtcaactcttgtaacttttcttctgtggttccaactctgctgttatgttctgatgctaaaatatatgtcctgaaaaatctagaaaaacagtgttttactccaatataacttgaaattaataaaagtctgattgtcctga

SEQ ID NO: 260313 - DNA, 460 bp, Homo sapiens
cagctcccttccatctcagcccttagacccttccaattgggcatggaactctaccttcactgagagttctaccagtgacttccaaatgcaagatactcagtgggagaggctggtggcctcggttcctgctttgtactctgatgcctatgacatattccaaatcatagaactgtacaatcttcctgatgagaatgagatatccagctcttctttccactgtctgtatcagtatctctcacccacaaagtaccaggtaggaggacagggttcctctctcagcatctttgctggtccagctgtaggcctatctcctgcacaaacctggcccaatatgacaagccaagcctttgaagcctacagtctaacagatagcctggaattccagaaaacctccaatatggtagacttgggatttctctgaccagagtactaataaatatagatcatttagaaaagtggt

SEQ ID NO: 260314 - DNA, 779 bp, Homo sapiens
cagctcgggcttggccaaagcccttggtcagctcggcaatttgcctgtaaagtgtggctgggcctgagcctgctggctctgagctcggagaaggagccgccgctgggttcagttataagagaactgcaagagcccagggtaaatatcctctcggtctccggacgagggggctggggagaaagggaacggctgattgctttgcattttatgatgggaaagacacctgctttgtagaaagggctgatacgttcctagtagcacctggcaagtttcctgcccagccctgaagcctaacagccgccttgcgattgtgtccgcactgacaccttggcctgtatcctggaccgtcggggtcaagtttgagcagcattaataaaaactttaaaagcacctcttagtacttaagtgacacgataaaatgcatattacaacatctgacttttgtctgtgtagattttgatgcagaaaagggaaggtggggagaggggatcctattggccacagcaatgaacgttctttccttctcaagtcagtataggccatatgctaatggggcgttaggcaattagctagcgcttcctctactaagagcaggcataagtgcctttcatttgagtagcatatattttataaattcaaactgaggagcacattgagtggaatggtacgtgtcattatataaagaagttggtatcgcgatgctatctggctgcatgttcttattattttacagtttaagaaatgtagaggaatcagacattaaaaatgtgcatacatgc

SEQ ID NO: 260315 - DNA, 544 bp, Homo sapiens
ttccagaggaaacttaagagacatcttagaatggtcaggggtagtgggctggtatttgagcagaggttgcagaatttgagaaagttacagctgaggttctttgttagtggcaagtctgctaagccctgggctatgctaacagctctgcctcatgctctttaatctttgagtcagacctatgagatacaggtgtagccccattttgtagtcgagagtgaggctcagatgtgaagcgactggctgaggttaaacttgatagtctgtttttacttattttctggccctcttcttgttgccatataattaggatgagtagggtaagcttgaactttttcgagtttttttctttttttccttcctggaaaatactgatttgactggctctggaccatgaaagtagctgggcctaaaaccaaaccagacatcaaaacgtggtaaggaccattcactaagacagccatggtagcatgctcagtgccagccctgtctccaggcccattcttaagatctcgggaaaagtcaccagatgcttgggctctaagta

SEQ ID NO: 260316 - DNA, 453 bp, Homo sapiens
gcccagggagagaggacggaaattcagcaaggacgtagaagagagtgcttctaccttaatcatcgccctgaggaccctgaggccaaagacaccagagctcctcactttcatctacagtttcagaagccagactctaacagatgagttggaaagatgcctttgaagggctcggtaatgatggctcaatgaggagttttcatttataaatgtgactcactgtggccaggccacggagggtctggagcagggcagacacaacagcaccaccctccaattaatggatgtgcaagaaccgctgtgggactcagatttgggccaagaaccccaaatcatctcccgtggctcagccctgagagccacccggtactctcggggcaacaggaaactaatgagctcctttctgttctggttggttttgttttgttatgttccccagcaacagaaggcatttct

SEQ ID NO: 260317 - DNA, 452 bp, Homo sapiens
agtttgtgttgatttggctagaaattattaaagttggtattctgtgaaattttgtttgagtggttctttgtttggttgagcgggttcagatgaggctgagaaaacaggaagattgtgcttggaagagggggagaaggcttccttaggccaaggcaggtcagtcattctataaggagagtctctatacaggatgtttctgcttttaaaaatatggtctgatatgcaaattcacttatctagtgcaaatgattctggcaaaggtttctactttcttgattcaggaataagacaaaagagttttccaccccatagtacacaacaaaaaagaggcattataaaacttttcagaactactaaagtggtatgattttatgatttcttgttgaattcagcatttgaaaacagaagaaatgtgaaaacagaggaaaggtgcttagcataggaattaactt

SEQ ID NO: 260318 - DNA, 433 bp, Homo sapiens
tctctgatgtcaacagggtctgcccaccctgccatctttagtgtggcttcctgcatcgccgatcgaccaagtggcagacctgagggcaaaaggaagcctgatattggagtcagccccctttggaagaactttccctacagcccacctagtaacttctgatgatacctccttggcctgatttaattcagtgcaccaaaaatattatcatttcaacacaaaaccaatgcaaacaaagaatatgcccctaaatgaaatggtgggatctagtttaatttttatcaagagaccttcctgaagccaagggccctggaaatggctgagtttccctgtggcttggagcagagggaaaaagtggaaatgatacctgtgttaagtaacatcaagcacccaggtccactggcatgtctgttaataaaaaaattttttaatgttt

SEQ ID NO: 260319 - DNA, 195 bp, Homo sapiens
ttgttttttggtgcaccacaataaaatttcaagcagctttcaactattataacctctactcaccacaacctttgttatgcttcatataatccctggcatattttctggctcctactgagtgaagatatgcctgagtctttaaaacctcaaagttcttaataaacataatgagcactcactgaatgccaagacttg

SEQ ID NO: 260320 - DNA, 484 bp, Homo sapiens
gcccattgggaatttcactccccatggtctgaggtagtgggattgtaatccggcagcattgctaatttttctactaattttacaggctttgccacactgtgactgtcaggaggttcttacttgcagaaggagatgcttcaggtacatgtttgtaccagagcattagtaaggctgcatcacagagtgagatgtgcatatcttcaggctctaaagacttaagggaagttcttcgaagctgacagtgaggcctttatgctttcaccatacgtataaaatcagtgtttctggattggaccccaaaaattcattagttctctgctctcagacaagacacttctcccagtggagcttgtttttcactgcctatggagagacaggtgaacaaaatgattccgtgtcttgacctatgacctctgtatcagagaatgactcagtagctactgtgaataaataaacccctaaatccaaagggctcaacacagca

SEQ ID NO: 260321 - DNA, 689 bp, Homo sapiens
acagaaatcagaatcctttgctggactttatagatgatttggtgcacttgttactagccttcttgggtcaaagacacattggaggacctcagaaaaggcaaggaaattccattttgaagaaaacataagactgcctgacacaacaatgtgcatacaatttcagaacattaatggaggccttagagctcattcacagatctatgctaagggctccagaactcccccagtcccctcggtgtgtgtgaatgactaagtcaaatccaaagtcagagcagcttgcagcataaactggcctccaggttcccagtcccactactcttgatcatgatgtcagctctctacagagctctgagataaggggacactgataattcctgaagtgattgtactgattgaatagcatcttcaaaatttattctacttggaattgcaaaatgttaccttatttggaaaaacggtctttgcagacataatcagttaaattaaaatgaggtgatactggattagggtaggtcctaagtccaatgtctggtgtcctttgaagatggtcatgtggagacacatgggaagaaggccatttgatgactgtcactgtgaactggcatcatgtttagggatcatggtgaggaagagattggaatagtgccaggaatgtcaaggctcactggaaaccaccagaagccagaaca

SEQ ID NO: 260322 - DNA, 537 bp, Homo sapiens
  misc_feature (360)..(360): n is a, c, g, or t
  misc_feature (497)..(497): n is a, c, g, or t
  misc_feature (500)..(500): n is a, c, g, or t
  misc_feature (528)..(528): n is a, c, g, or t
cgagtggatggcaacagcatttggaaggcggaggacatggaattcatgtgtcaggagccaccttccgagcctccagtaccacgtgtcagggccacatgagctgggcctcgtgggcctgatgtggtgctggggcctcaggggtctgctcttcttctctttcagaatctggggctccaggctatgccttggctggactgaggtctgggggtgcacttattatccctggggacacctgctgaagcttctccctgacaagctgtgtcactgttggatgagataatccaggcccaggttcccagggggagggaaaatggagaaaatataaaaagatgtgaaaaaggaaaaaggaaaggtaataancaaacaaccaaagtgataaatggatagttaagggaggttgtctgaacagggattataattagtttacatacatactccttaaacagataaatacattacacctttcaaagatagagctaggaaaggcaaaaatgaanctnaatgaaagcgaaagggaaaataaagaanaaccaataa

SEQ ID NO: 260323 - DNA, 241 bp, Homo sapiens
tccaaggttgctttgcgaggaataggtggggcatcaggaagaagccagttgcaggcaaggcctctgctgatgctgcttttttctcctgtacccatccatgggagggagctgtgagatggcctggcagaacccgctcttggaccccacagaatgagaggctcaccctgcacaggaacatcctggggcagcaggctcagcacattttaaattttgagtatgaacaaagtaaacttcagggtta

SEQ ID NO: 260324 - DNA, 188 bp, Homo sapiens
gatcccaaggcacatacagggtgggagaaggtgcactcccattcccaagggagccaaggcagcactgaactcggagagtggctctcggttagaccaggaggtgaagatactgggggaggaggaggctggctgatgatcccagggttagaccaggaggtgaagatactggaggagaaggctggctgatg

SEQ ID NO: 260325 - DNA, 683 bp, Homo sapiens
cttgaagtaaatgagatttgaaaacttaaagctcaaaaatcacttaaagtaaatgaggtatttggagattagagcggctgaagtttcccaagcattctgctagtgttactctattttaaaaaataccacaaacccattgatttaaatataaaagagaagtggctaaaggtataatcctcgttactttatagtcataccttataactgactacctcttacttgtaaatagatagccaatgtgtgaagaatagtttaaaaagcaccattatatcagtgctgacaagcagaatactgaaagagagcggggaaaggccgaaactatccccaaagatgttgctttaaatgatcatgaaaagtccagatagagatgataactgttttttgacagattccaattttaagagttcaaagtaaattctattatatatttttagcaagtttacttccccctttattttgaaaaacagctttatacgttcctgactataaaaatgttgcccaaaacagaaacttaaaaagaatactggataaaaaagaagtattacctgtaaaccccagagttaacttttgttggtataattgaacatttataaaaattcctaaagcatgggttttgagatttgtttctgtgcctatctttgttcacccccttgtggccatgatatgaagtcaagagctaggca

SEQ ID NO: 260326 - DNA, 428 bp, Homo sapiens
cccaccacactccatgaattctaatatgctcttggagtgagggatatagccgtccttgttctagcactgaaagtggaatcctgggaaacctttcagtcctgggcaaaccaggccaggtgcttacgctaaccccagatgaacctgatgaagcctcttctctcatcagttgagagtcactggcctaaaagaattgcagatgagttaatgaaggctggaggaaaagtacagagccctgggcagagagctgtgtacccactatcatttcttcattctacaggacagtgtcaagggagctagaagaggacacactgtgatttgtagtcctgcccaagtgctccttgtatgccttgtgctccaagtatcccttgtgctcctactgtgtcctgcagtaggagcacaagggatactactggagctgggaaggactc

SEQ ID NO: 260327 - DNA, 444 bp, Homo sapiens
gttgctcagagtccgaaagcttttcccagcccagtgacacccggaacccgtgaatcgggtggcacgttgaatcaacaggcttcctggcatcccgtccttctctccgcaggtttttaaaactgggccacgcaaaaggattggggatggaagggacctggggcttctgagccaggatcaggtgatcgagttgtttgttctggggatatgaatcctgtggagctttcagcagctcggccatcaggctagagggcgatgccaaattccagctctttacatattgctgaataatacaaatagaactttttgtagatggttgcatccttcatccctttctaaagatcgaaggtcttgtagaagtcctaaagcccgtccattctctatagattcatttcctcaaacgtttgccagaggcctatcatgaacatcaaaattagttattaagtc

SEQ ID NO: 260328 - DNA, 414 bp, Homo sapiens
taaaagttgggttgagggtatcttggaagagagagaatataggaaaacaccccctgtttgtgaaagtagctaacagtggcacacacaatcactggcaaatcccaaatatgtattttacagaaaggtaaggcaagggaatcagtgactagagagcgttgtaaacagattttgaggtttttttttttcaatgagaataagtagataagatcctcttaaaaagagctcatgttggaaagagatagctgacaaattgttttcctatcttaatctgaatctagatgtaaggtggtaaggacatgccttgtgttaatggcataagagttttttttttaactgccaggtatgataagtaatttagaacaaattattgggttactttgattatgatgaatttgtgggttaagggcactagta

SEQ ID NO: 260329 - DNA, 179 bp, Homo sapiens
agcatctccaccttctgcatgctgaagttatgtcacaggaggagggcctcagcacacgatcaatttttcttttggtccattggcagcttctgtctcagaatttttgtgtgtgtatatttgtagaaaataaagaggtacggtcaaggctacagccactactgaccattgctgccaccatc

SEQ ID NO: 260330 - DNA, 217 bp, Homo sapiens
ggggctgagctacaatcaaagggggcactccaacactcacctggaaccctaatgaagctacggaggtgttgggggtgggcagggatccacgggcgggatggtaaagagagggagaagtgcaaagctaggtgccagagtaggagtctctgccccaacttacttctccatcgtgcctaggagggcaatttagataattcattgtgtcatacgtgtgttc

SEQ ID NO: 260331 - DNA, 701 bp, Homo sapiens
ctggcatcttctgcccccagtccactctgctgcccatcttggccttcactggcatggattccggtcactcagccctggggcttggctcccatcccttagtcacagagcacacgtgcacctcagccccttcttagacatgctgccaaattttgaccaacgtctagcactgcctttgggttcaccgaagatacatactgttctgttgtccatctgaatggcggtacagagcagggtgtgaggcattgcctgaggacaaactgtcatccgaataggcaagaattctgcttagggtgtgtcaaagagcaaaccaggactgaaaattcactgtgtaattagtgcagtaatgcagggtgcaatttaactccttctactttctagctctcaaaggtagtggatgaaattctgccccaagaacaaaaatacctgaaaactagtgtccaccaactatgcagagaggctcagaaaatatttggggtcatattctctttatctttcttgtctcccataagaaagcaggcctttgtctgaaatccccactgcacacccatccacagagacagaagtccctggacatcaagccacgagggaggggacagaagggatgagaatgaaacatgccccactttcttttccactcaccacgcagatcctactccaacctcactacactcaggctcttccctgctatgaatctgcttcct

SEQ ID NO: 260332 - DNA, 687 bp, Homo sapiens
gccagaagcaggaatagaatccatctctgttgaggtccctgagggcaaggcaagtagctcctcttgacgtgtgtcactggataaacagaactctagtaaagagtttgctcatttttaaaagtgagaagagttgctcagttgttctaaaaatattgtgtccttattaccattgcctttggaatatatttgttctgttatttatctcagaaataattctacctctagaatacatgcaacacagttctatagcagaagtaataatacacaattgcagggtcacgttcatgtatagaaaaccgaaatctgtatctatggcatgcaattgatgaatgtcctctccacatgaattttattggcaaatagtaataattgatagctgggcagttctctacttttccaagcattctcatcttttttttttttttttattctcagagaaatatgtgaggtctttgggcaggtggggctttgttcttccattctacctgtaaagaagccaggactgaaggagctttttacagatcatggagccagtcttggattaaagagctttacagatcatggagccagtctgggaacctcagtgagactttgcttcctctacacaaagcttccctcattcatgtaaagcaaatcatagaatttcccttgctttagaaatatattaagctcttaaagataaaattc

SEQ ID NO: 260333 - DNA, 668 bp, Homo sapiens
ggcaagaacctcacctgtcttattcctcatcagcactagagaaatggttagcatataatatatacttcataaaatttattgaataagtgaattaggctactctgagacttaaataaaattaccacacacatgcatgcacatgcactcatatttaataattgactgacccaaattcatttattaatgtttgaagtaatagtgttaaaaaggttgtaattcatggatgtattaatcaactgattataatgataatttttctaatagaaaagctaagaacaggcaccaccaagaaagtgaatttgaacatgagagagatgtgtgatacctgagctaactctgtgtatagtacaaattttagatcttcattcttggaatgctgtatctagaacatccttcaaatatgattggttctttgttcatttgtttgcttgatgaagcaatattaacttcacttgatgaagtaatattacccagatgtcaaaaatgataagaacaaaaataattctatggcctaccctcgttcataaagatgaatagatcctaaataaaatgcatcctacacaacgcaatagtcaattgatgaatcatctattagaataaatagagtttactccctggaaggcaaagatgttttaattagaaatctattaccataaaacatagaatcc

SEQ ID NO: 260334 - DNA, 419 bp, Homo sapiens
gtcagagtgtgggtggggaggaggaagagcattaggaagaatagctaatgttgggctgaatacctaggtgatgggatgaactgtgcagcaaaccaccatggcacacattacctatgtaacaaacctggacaacctgcacatgtacccctgaacttaaaattttaaaaaataaataaattgcccaaagtcatgcattgtgcaaatagtgaagctggaatacagattcaaatagtttgtcaacaaaacccaatcttaaagctatattgccaatcttggtcatacaattttatacaaaaaatatttgctgaagtcttatgtggcagactctgtgctagctattagtgtctcaacaacaaaaaatatatacaggtaccatctatgcctttaaggagcttaaagtgcaatgcatatacgatgca

SEQ ID NO: 260335 - DNA, 446 bp, Homo sapiens
  misc_feature (148)..(148): n is a, c, g, or t
ggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactgggntaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtcctacaggtatg

SEQ ID NO: 260336 - DNA, 2265 bp, Homo sapiens
  misc_feature (74)..(74): n is a, c, g, or t
accttcattgtaacccactcaaccctggattcttttcgcagaatgggcctgaaagtcattcagcagaacgtgcncaagttcctgcagctccgtttctggggctggtggaagctgtacaacaaggtcaagccactcctgaatgtggctcggcaagaagaggagatgaaggccaaggaggaggagctcaggaaagccatggcccaaacccaggagttggtaaacaaggtcaaggaactggaggagaagacagccacgctcagccaggagaagaatgacctcaccatccagctgcaggctgagcaagagaacctgatggatgcagaggagcgcctgacatggatgatgaagaccaagatggatctagagagccagatctcagacatgcgggagcggctggaggaggaagagggcatggcggcctcactgagtgccgccaagcgcaagttggaaggggagctgagcgacctgaagcgggacctagagggcctggaaaccacgctggccaagacagagaaggagaagcaggccctggatcacaaggtccgtaccctgacgggggacctctcactccgtgaagactccatcaccaagctccagaaggagaagagggccctagaggagctgcaccagaaaaccctggacgacctacaggctgaggaggacaaggtgaaccacctgaccaaaaataacagcaagctgagcacgcagatccatgagctggaggataactgggagcaggaaaagaaaatccgggcggaggtggaaaaggctcgtcggaaagctgagagtgacctgaagatgaccatcgacaacctcaatgagatggagcgttccaagctggatctcgaggaggtggtgaaaaagagggatttggaaataaactctgtcaactcgaaatatgaggatgagcagtctctgaattccacgctgcagcggaaactgaaggagcaccaggaccgaattgaagagctggaagaagaactagaagctgagagggccatgagagccaagatcgagcagaaccgcaagcgggaggctgagctgctgaagctgcggcgggagctggaagaggccgccctgcagagcgaggcgacggcctccacactgcgcaagaagcacgtggactccatggccgagctgacggagcatgtggagagcctgcagagggtcaagtccaagctagagaaagataaacaggtcatgaaggctgagattgatgacctcaatgccagcatggagacgatacagaagtccaagatgaacgccgaggcccacgtcagaaagctggaagacagcttatcagaagccaacgccaaggtggcagagctagagcgaaaccaagcagaaatcaatgccatcaggacccgcctccaagctgaaaatagtgaactgagcagggaatatgaagagtcccagagccggctcaatcaaatcctacggataaagacatctctgacgtcacaagtggatgattacaagaggcagctggatgaagagtcaaagtctcgcagcaccgccgtggtgagtctggccaacaccaagcacgacctggacctagtaaaggagcagctggaggaggagcagggaggcaagtcagagctgcagcgcctcgtgtccaaactcaacactgaggtcaccacctggaggaccaagtacgagaccgatgccatccagaggacagaggagctggaggagaccaagaggaagctggccgccaggcttcaggaggcagaagaagcagctgaaactgcccaggcccgggccgcctccctcgagaaaaataagcagagactccaggcagaagttgaggacctcaccatcgacttggagaaggccaatgctgcagctgctgccctggacaagaagcagaggctctttgacaagatgctggctgagtggcagcagaagtgtgaggagttgcaggtggaagtggacagctcgcagaaggagtgccgcatgtacatgacagagagcttcaagatcaagactgcctacgaggagtctctggagcatctagagtccgtgaagaaggagaataagaccctgcaggaggagataaaggatctcattgatcagctgggtgagggaggaaggagtgtgcatgaactgcagaagttgaagaaaaaattggagatggaaaaggaagaactccaggtggccctggaagaagctgagtcttccctggaggttgaagagagcaaggtgattcgaattcagttggaactggctcaggttaaagctgacatcgaccgaagaatccatgag

SEQ ID NO: 260337 - DNA, 1129 bp, Homo sapiens
  misc_feature (74)..(74): n is a, c, g, or t
accttcattgtaacccactcaaccctggattcttttcgcagaatgggcctgaaagtcattcagcagaacgtgcncaagttcctgcagctccgtttctggggctggtggaagctgtacaacaaggtcaagccactcctgaatgtggctcggcaagaagaggagatgaaggccaaggaggaggagctcaggaaagccatggcccaaacccaggagttggtaaacaaggtcaaggaactggaggagaagacagccacgctcagccaggagaagaatgacctcaccatccagctgcaggctgagcaagagaacctgatggatgcagaggagcgcctgacatggatgatgaagaccaagatggatctagagagccagatctcagacatgcgggagcggctggaggaggaagagggcatggcggcctcactgagtgccgccaagcgcaagttggaaggggagctgagcgacctgaagcgggacctagagggcctggaaaccacgctggccaagacagagaaggagaagcaggccctggatcacaaggtccgtaccctgacgggggacctctcactccgtgaagactccatcaccaagctccagaaggagaagagggccctagaggagctgcaccagaaaaccctggacgacctacaggctgaggaggacaaggtgaaccacctgaccaaaaataacagcaagctgagcacgcagatccatgaggtaatacccattgctgtggccacctctacaactccaaggccagatccctctgggggcacggggtccgaagattagttttgagaactggaccaacacatcccccggggcgtgagggcccttctgatgccacagctaaaggatcggacccagtttggttccttcttgccttctgacctcagactctcctcgtctaccttctcttgctgttcttgtctctgtagctggaggataactgggagcaggaaaagaaaatccgggcggaggtggaaaaggctcgtcggaaagctgagagtgacctgaagatgaccatcgacaacctcaatgagatggagcgttccaagctggatctcgaggaggtggtgaaaaagtatgtcttgtcgtcgttcgttttgtccatcacaatggtagcaat

SEQ ID NO: 260338 - DNA, 747 bp, Homo sapiens
ggaataccattttaaatattttagaaggtaatacaggaaaatttgaaccaatgtaaggaaggagttgttggatgtgactcaaagtgggaaccatgaagaaaaagagtcacacatctgactatattaaaactagaaacttaagtatgacaaaagacactgaatattagagggccagccacagacgtggaaggtacttaccttgcaattatctaccaggaactgacaaaggaagtgtccaaattacataaaggactacttaaggggggaataaatgagtgatatatgagagagaaccaaaaggtcaattaacagaaaaatgttttagctcactaggagtcaaggaaatgccagtcagcacagttagataccatttcacatccagtcagataatatcagggatggcaaacatgttgagaaaataattcatactttagtaaagttgaaattacatattgcttataacagcagttcaacatctgtctttttataagactaaagttttgcatcatatttaggtacagaaattgtcagaacacttaaagcttgtaggcatttgttgctgggagaagactgaattgcttttttcaaaaactggaaatcacattgatgtgttgtaaaagagaaccttagatttagagagggaaaaaaaactacagtattttgttaaatttatctacatttaaagatactaataaatgcagtttatgaactaccagtctcctatattggtcatattttgacaagtaa

SEQ ID NO: 260339 - DNA, 667 bp, Homo sapiens
cagttggttacccagaaccaccctggagtgtgcgccaaactcagtatggagcactttctttagagtggtcagcttcatgattgcaagatggctgccacagttccaggcatcacagacattactccccttctccctccccacagagaacaatgaagagatttttttttttttttttcctgagacagagtctcgctctgttgcccaggctggagtgcagtggcactctctcggctcactgcaacgtccacctcccaggttcaagcgattctcctgcctcagcctcccgagtagctgggactacagacgcataccaccatgcctgggtaatttttgtattttttagtagaaacagtgtttcactatgttggctagggtggtctcgaactcctgacctcgtgatccacctgccttggcctcccaaagggctgggattacaggcgtgagccactgcacctggccaatgaagagctctttattgtgtgtgtgttttggaaggaaaaagactcttccaactcacatctcattggccaaaatcaggccacatggtcgctctctggcagtaaagtttagctattccctgagagcctatggcagcgtaactgattgcatttgactaagtatttagggtgcatggatgtttggcaatcagcctaacctctcgctgcag

SEQ ID NO: 260340 - DNA, 338 bp, Homo sapiens
ctggaataagtaagacaccatcactccctttcccatttcttaataaaggggaaaggattcccctttataaaggattgcaatttcccccaattcctttattgggtctatcaaaggtatgcaataaaatgtcccactacttatacatgccatataatttaccagttcttcccatcgtcacttggcgagacttccctccccagttctctgtcctactgtttcaggctgagctggctactctctccttgccctgagattttacttatcttttgccacccatgttcctggatgccttgccttcctctttcatgattttgagtttttgagtcctggattccaga

SEQ ID NO: 260341 - DNA, 344 bp, Homo sapiens
aatgttttcgcaatttgagacgctgatgcagccgccgctgctccacctgcaatctgagcgttgcctctctttaatgccactttgataccgcgccttttgagtcctttttcctacatgtatttgtaatttatttctgcaacagctagaacttactgtggctgctgtttaccctctagttgggctctactgcgaggcaaggcaaaagtcaggtccgtcggcgccctctcctggtaaagctgcgaagctgcagcaaacagagctaaattggtattttcccgtttgctgcggcaaatttttattaaagtgtaccctatatttatgattattaaactttagtgttcgcc

SEQ ID NO: 260342 - DNA, 324 bp, Homo sapiens
cagagagaggttgccccagacaaccaagaggaaaagaggggaagcgagaaagagacagagacccaccatcctggccaacaaccctgcgaagagggaaattggcagtccatgcacaggacccagcctctgatcaagcccagcaggcacaggctggccacgtggagtgtggggccctccaagccgcgcccacccagaacctaggccagcctgccagcgcggcttgcagtcccggctcccacctgtgcctctccctccacacctccctgcgagcagagggagtcggctccagccttggccagccccagagaggggcccccacagcac

SEQ ID NO: 260343 - DNA, 385 bp, Homo sapiens
gtaaataaacagctgcttctaaagaaaatatctattcgtaatctaagatcttttagaatgaaacttgccttgctagtttctcattatcataactacatagatagattctaatttatcccattttgacctgatacacagtctaaccttccaagactgtcaagttgaagggaataaattctcaggcaattccaatgagtagaatctgtcttttaagattgcacaatttcctctagtgacagctatcaccctggaaaagacagtccaagtaatgaccacacattaacacagacattctcaatttcctcccagcatacttggcagacagctagagggtggaggggcaaagcaatgttaagtttcaataaaagagagagagaaaaaaagg

SEQ ID NO: 260344 - DNA, 629 bp, Homo sapiens
tgagatggagtttccctgttgttgcccaggctggagtgcaatggtgcgatctccactcactgcaacccctggctcctgggttcaagcgattctcctgcctcagcctcccgagtagctgggattacagatgcccaccaccacacctggctaaattttttgtatttttagtagagacggggtttcaccatgttggccaggctggtcttgcactcctgacctcaggtgatccacccacctcggcctcccaaagtgctgggattacaggcgtgagccaccgcgcctgacccagtatagtgctttttataattaattgtgtacttttaaaaaacctttattcatgataaagtaaatccagtctactgagtggctgtgctatatctttaacagctattttatctttatttccttcagtgttacagcttccctacatagtacagattatgttacctaattaaatagttgagctatgtcccattctagttaagaaaactgtcctgttgcctattttcatctgattaaaattttctgactttctttcaatatctgtttttttgtaaaccagcctattcagttttatgtcccaacgtcctgttctcttgcttgcccactgatttttttctccatcatta

SEQ ID NO: 260345 - DNA, 541 bp, Homo sapiens
cagctgctagtttggttaagcagaggagaaagctggatgtagtccatgagaatttccctaaaaatgggaaataaagcacatttcatctccagtctgtctgtggttaaagctttctaaacacattgaaactactgcttaatataagtttacagcaaaaatccttttgaatttggagaactgcaagatgtcttgctcatattccaaatcctttctgcaaatttcccaataaagagacgtaagttattgtcttccacagcagggattctcaacctcagcactatggacattatgaactgaataattctttgttggaaggtactgtcctgtgcattgtaggatgtccagcagcatgcctggcctctaataaaagtcagaagcaccccactccaggtacaacaatcaacaatgtctctagacactgctaaatgtcccccagagaacaaaactgcccccagtggtgaacctatggtctacactgagtcagtgtttcagatgattgttctccttgcatagatgaagacagccaagtaggaacttaaga

SEQ ID NO: 260346 - DNA, 143 bp, Homo sapiens
tttgaaactatcagttatacatctatcctcctttcaattttacgtcacttggatatctcctgttgacatcaaacgccatcgtctaaatggacattttccatcattttgcttcacctcttctcgtccctctccaatcccctcat

SEQ ID NO: 260347 - DNA, 678 bp, Homo sapiens
caagtcagtgattttcttctcttcattatagtttccagccaccaaacacgtaaaaatggctgtcagaaggcttccctacaccttaagtgcaaagagttgtgactcacttatccaaaaatcccagcatagagccagctgatttcacaagtatttacaaagtgttaccagagacttttgaggccccgtaaggctttacctttacttgcaaagtccgtttgagctaaactcctaaacaccctcttccaggagattgattgctcattttgcttaggttttgaggaggaaaaattaaaagcaagcaattgagccatgattaagtccctgttatttaccttcttttttctttttgtactaataattcttagtccacattctacatgagaatcagtgggtaaactttttaaaaagtaaagatgccttggctctaacccctaacaattctatttctatttatggagatgggagtgggaggaggggtcagtttttttgtaagtcccccaggtaactctaatgtatagcaaaggttaagaaccattgttctgtatacacacagtagtgaccatgtgactgctctgtgctggtgtgaaggttgtggtgcaacatgtttgagaataaagtaatcctgatgcccaacctaaagaaatgatgcaaaatgaataaatggaacaaatcaaagga

SEQ ID NO: 260348 - DNA, 363 bp, Homo sapiens
agatggtaaattatatatgtgtattttatcttaattaaaattttaaaaatcaggagtttagaaatttttaagagaagtgtgcccatagtgataagaaagaaagacccttttggaaaattttcttgaacaaattatacagtattttcttaaacaaattgtacattctgtagcagttaatacaccaaataagatttcagggttacctcttggagattgtatgaaataaaaacatttaggtgggcatgatggctcattcctgtaatcctaaaactttgggaggctgatgcaggaacaatacttgaggctagtacttcaagaccagcctaggcaacatagtaagacccagtctccacaaaacaacca

SEQ ID NO: 260349 - DNA, 367 bp, Homo sapiens
agggcccattttgcctctttgtttcaactcaggcatttgatccacagcaagcattggactattactggctttagaatgactcaagtaggccgggcgcagtggctcacgcctgtaatcccagcattttgggaggccaaggtgggcagatcacaaggtcaggagatggagaccatcctggctaacatggtgaaaccccgtctctactaaaaatacaaaaaaattagctgggcgtggtggcgggcgcctgtagtctcagctacttgggaggcttaggcaggagaatggcgtgaacctgggaagcagagcttgcagtgagctgagatcacaccactgcactccagcctgggcaacagagcgagactccgga

SEQ ID NO: 260350 - DNA, 219 bp, Homo sapiens
ctaaggaagtaaaaataatataattggattatctttcatctccttgccaaaaatgatttctctgctgctgtgtcttgacatcctccattggtccttcagatttacagccctaagaagacaaggagtgcttctgttctggtcaccactgaatccccagtgcctaatgcctggctcataatagactcttaataaacacttgttgagtgaatgaacatctca

SEQ ID NO: 260351 - DNA, 343 bp, Homo sapiens
ctgcgcgtgaggctcagggagggatgggatcctaaaagatgcaggcctgcctgtattcaggagtacccactggccctgcttactcccgcccgggccaagtggagaagaagttagatgagttcttaggaggagagaggcagcttctttgaggtggtcgagtggcatcacaaacaagcgttgaatggaaaaagactagaagaggcagagcctgtcacaggttcaccatcatccagccaacactatgggaaatctcacacccaccactgtcaaaccgaggactttggacttaataactgctcagaattaaacgaccttaccttccatgggtgagggcttactgcca

SEQ ID NO: 260352 - DNA, 241 bp, Homo sapiens
atatatgtgtgggttttttcctgggtgctgttatattgatctatatgtctatcatgccaacataacactgtttgttcagtagtaagtcttgaaatcacatggtttaagttctttttgttcttttttgaaattgttttcactattctaagtcttttctatttccatatcaattagagaatcggcttgtacatttctacaaaatacttctgggaattttaatttccattgtgtgaattcagtg

SEQ ID NO: 260353 - DNA, 1167 bp, Homo sapiens
accctccgcctgccccgggagcctcagagtctggcccaggcaggtcggactggactccgaggaggggaggttgagccaggacctctagaacaccatggaagtttactccagagatcaggctgagcatgtgccagtctctctccctccctcaagaaacctatggagatgatagaaaacacacaaatagataaatagccatttataacgtacacagagcacaactgtggtggaaaatgacaagggagactcagggtgggtcttgacaacatcccacagaagaggcgctgacgcagcccccaccctggtggcgaaggaagtgctcccaggatcattgtcatgtcaccagagcccagcagggccagcgtcaggggagctcacctcaaggaagccgagctaatgagacagtcagaaatgagatgatgccagccaggcgcgggggctcatgctgtgatcgcagcactgtgggaggctgaggtgggcagagcgcttgagcacaggggttcgagaccagcctgggcaacgcagcaaaaccctgtctctacaaaaaaacaaaattagctgggcatggtggcacgcacctttagtcccagctacttgggaagctgaggtgggaggatcacttgagcctgggaggttgaggattcagtgatccaagatcgcgccactgcactccaacccgggtgatgaaacaaagccctgtctcaaaaaaaaaaaaaaaaaaaagtcacatttccagagtgctcggggcgggggggcagaggctgtggaatcaggaatgggtggtatcggaagccagcaagccaccgtggagtgcgcgcctgcctgcgaggtggcggcaggacctcgatcacacaatcatgcaaacgcccgctgtgtggtggccaaggagatggggctggagctgcctgccccgaggccaagggcctggtcagcggggcgggtggctggggtgggcccaggtgacagcgaggccgagtggctgagacccccacatgccaaggccccaagagcctccccgcctgtccggaacacttggaacatgtttccctcgcacgtgacccctcgagatgcttctgagacgtgccgggcaagacgtcaccacagggagcccgggccgaggcgcacgcctctgatttcctgtagctgcaagtatatccagttttctca

SEQ ID NO: 260354 - DNA, 649 bp, Homo sapiens
tggggaaggggtgtgaaatcacgaggaataagcaagcatggcagctacaggagtttggtaagattcacagggtgaagtgtggctctgtcactgccttggggcgtcacaggagaagaatcccattcccctctttagtgctaaggttggggcggcagcagcaggagggaggtgagctgtcctttacttccatttctagctccatttccaaaacgcatccacagtgcagggtgggagtaaatggcccaggacagcaggtaggacagatataagactacagaaagaacttctcagggctgagtccttggactcaaagtagtctctggggctcaaacttgctttgtcagaagccctccaaccaagcatgcgaggctggtgacacgtgggagggcatggaggccccagcattgtatgccaaccaatgggagctgcagacaaccaatctcctacctacctttaagtctgacctacatttgtccagagtatctacacctctcccatatcttctgaaacaatgaagcccagcagtggtctccaatcctaggaagtccttcctgctatctaacggccatccctcccaccgcagccaatcttccactgttacctaacccaatttggtcatctaaacaagagcaatggacaggggcccttg

SEQ ID NO: 260355 - DNA, 691 bp, Homo sapiens
aagatactgtatatacttaaaaattatttcaaaagaatttaaggttcaaattgtttactaaatttaattgcccctttccttttcctacatccatccctattcatctgaatctataaatttctgctgtaatttaattttccatgataatttttgaagttgttagtatataacaatctgccattctgcttgcatacagaataaatggaatcattgagaaattctccactgttttcaaatactaaatgcattttaaaattgaaaaatattttattgatatctgagtttaaagatagttcactcattaagagcctaagagctcttcaataagttgtaatcgtgtggtataaaagcttcattctgattactcaatcatgactaaaataacacttaagacacccgattcctgcatttcagcagcaacttgctgaattatcttttcataattactaatatgctaaagagatattattgagccaagaattgatgctgttgcctgacaaaaacagcgtagtttcagaaaaaggtaataccaaaacataaatactgttttatattaaaatttttaaaatataatgttgctttggtagccatgaaacttgtcaattttttatcatcacaaacataaccatcaccgaaattagattttgctgtttcaggttacttcctgaaatatatagatatttatttaggg

SEQ ID NO: 260356 - DNA, 435 bp, Homo sapiens
gcagcctaccccccttaccaatgacccacgccaccctcacactcccccacacacccccatcacatgtcaagttctttgccaccccaaagtgaaggtccgcccacttccaggagtcctcagaagttatctgtgttgttctgagtcacgcacgaaactcagtgaaccagacagaatggattttccccaggcagccaccacaaccctggagttggaatcaggagacctgagccaactgagtggggggcaattggttaaagtcaacagtctacctcctgtgtgatatcaagtgagccatgtccattcttgagcctcagtttcctcagttttaaaatgaggagtggcctgaatggtttttgagctgtcacagatggaaggagaggctctaaggcagtggaactatctgcaggtgttggaagggtcagtcaggaagacttt

SEQ ID NO: 260357 - DNA, 539 bp, Homo sapiens
ctgactacaatgaaaataaaggacagttctcggctcccagaatccctgtcacatatcagataatcaaaactagtctcctggaaatttgctgattttacatatttctaaaatctgtaaccttgtaaatattctgggctctctgcatgtttcctgtgccttaatgcagttacaaggggtggcttcgagtaaaggagggatggctttttgaatatttaaggagagaaattgtgaaatggtcattttcaggtgcgggaaagcagacctgctaaggaaatgcagttgaaggctcattgagatttgcagtcatgaatttaaagtgaaacccattggcatagctgggtgatttttcaccctagtttcagttaggttaagaaggtaataggaaccatcaggagacagggttataggggattttgttgatgacaggctatgattccccagagggaagaggtgtggaaggcaaggaaggttgagatactgagttggattagagaactatagataatgatgggaatatagcaagaccccattctccacaa

SEQ ID NO: 260358 - DNA, 482 bp, Homo sapiens
tgttactaggtggagcttctctgtaaaaaaaaatactataatgaatcattttaagtggagcatgtttttgtaaaatggatgatcatcaccctcctttctctcactacctctcccaccattcttttgtttcacatattttatactgtgaaattttcaaattgcagctgtcaatgttgtgcttgtgatgtatttgagaatgcattctatcctcatggaaaagaacacattcaatttgaacttcaagtttgttagttttctttaattatgatatttgcagtcattcttagaagagatatttgtctccaaggattggtgcacagtttgatttctgtgggaagatatgctttaaaatatgtatcggtgggggttgttaaaatagtgggattggggtggaggtggaattgctatttaactggcagtttcatcagtatagaaaaccttgatgtattcatgtagattatagattaaaaatttaaagtagt

SEQ ID NO: 260359 - DNA, 631 bp, Homo sapiens
atgaaaggttgaagggattttgggtggtggggtgggggggaatggcgtagaagttggcctcaggtataaaaattgagctgccccaaggtagaaatggaaaatgtctcgcccggctgaattattccaggcaaggtgaagatgaccggttctccccactaagaaatgtctcttatatgttgggttcgcccttatatgttgggttcagagtaagtactttcttcccctgcgcgggagttagggatagcagaactgtatttaataaacgaagactgaaatggggccaggatgcagtgagtagatccagtaggttacatggtcctgagagataagagactcaaagagccacccagcagtgaagacacaaactaccaccccctccaccaccaccagtgggcttccgtggagtctggggtacagatcagactgcactgtatttgtttccagaatggtcaattcttagtaatcctacccgagactgtctttttctctgccctcccagttcgtgagtggaattctatgcctacatttgcctgatgcaagtttttaaatatttccaaactgaccaacccagtttctcttaacttcttccttccccaattttctttcatttttaccaagttaacttcacatt

SEQ ID NO: 260360 - DNA, 257 bp, Homo sapiens
agctatgtgatgtctgcatgtgttggctggggctgtgtggcctaaagcacctcacctcatctgtacaatgggcatcataacactgtgtatctcaaaggagagttgtggggatcagaaggaaatacgatgtgaaaagcccccagaaaaattcctggcacatagaatgctcccaatcatggagagtatcatgatgatgagtctttataactcacctagtgatggcaccagtgtggcaggtagctgagagtgatcaaagg

SEQ ID NO: 260361 - DNA, 392 bp, Homo sapiens
atttcccctgatggctaatggatgctttttatgtgctgttggacatttgtatatcctctttggagagaagtgtgtgaaaagactcaaattctttgcccatttttataatgagttttttaattattgagttgtaagagtcttttttatactctagatgtgtcccttattacctgacatagcatctttatttttctaatccacatttcacaattctctcaaaactcaatcctaacactctctcacaaacacacacactcacacaaacaaacactcaacaatctaggaaatgaacttcctcaacctgataaaggctattaatgaaaaacttatagctcactactttccgcacactgcctgcctatgggctagcctttctcctcaaggagcagttt

SEQ ID NO: 260362 - DNA, 285 bp, Homo sapiens
aatgataccattagcaaaaggccagatttgtgtgtgtgtgtgtgtgtgtgtgtacctattatgtagtcatcttcactcagtgggatatggcaaaaaaactcatttctttgtcaatgtttgacttatgtaatgagaacaaatatgtatctgttactaaagaaaagacctggtgagctcaatgaatttgtaactcataacacactaatttcaccaacctaacatttgtaattctgtttgtttctatttaaagaaaattagaattaaataaagagcattggaagctga

SEQ ID NO: 260363 - DNA, 182 bp, Homo sapiens
cttccttatccctctgttttgactattcaagaccaaagatatgcagagttcaatgggggtagtggttaagagaacacatccttaaaaattattcatcaagatgagattgtggatctactgcatagtaaaatacaactttggcaagttacttaatctgtcttagcttcagttccttctttgtg

SEQ ID NO: 260364 - DNA, 444 bp, Homo sapiens
agactgagctctccagcctccatctcacaacaaatctgaagagggcccagcctcagttacagcccctcttactgcagtctggcaactatcctgtctgtgcagggacctgctgagaggcaaagacttgtctaagacaatgtgatagacaaggcagcctccattccacaatagatcccaaagggcccagtctcagctccagctcttcctactgcacatgcttgtgcaggtatctgctgggtgatgcacactcatgtaagccagtaagacaggccaactaggctcctccccacagcagatcctgaaggggccaatctcaactccagcccctctagctacagcctgagacccatcctgccagtgcagagacctgctgagaggcatgcctgctgggccattggtatagtttttgagactcaggtccgtgaacagtattcccttacaggc

SEQ ID NO: 260365 - DNA, 283 bp, Homo sapiens
gagcggcagcttcccggcaccatccctcagtccctgcctctcattctgctggagatggccccgagctcagggcgggagcaatcctacataactcactacccagaatggaaatgccacatagcacatttaattctgcactgacagttctcgggaaacaggcctagttctccatcgacctctaaaatagatgatggttttggtaatagcactttcttcaggaaattccattcatgttcattcatttattttagaccacaaatattcatgaattttgtacagtgtg

SEQ ID NO: 260366 - DNA, 407 bp, Homo sapiens
tgagtgtcttgcctttaacaggctttgactgaactaaaaccacattttccagtcaaccttatagtgataaaaataatactctggtcttaattaatgtactgtgtctaaaataatgtattatatcagttattgtaaccacccaacaagttcttgcctgctgcccaggcagagccaatttatcaagacaagggaattgcaatagagaaagagtttaatacacatagagctgggtaaatgggagactggagttttatattactcagcctcagtgaaaattcagaggctgggattttttaaagatagtttgtctgtaatcccagcactttgagaggccgaggcaggcggattggttgagccttaggagtttgagaccagcttgggcaatgtggtgagatgctgtctctaca

SEQ ID NO: 260367 - DNA, 440 bp, Homo sapiens
tgaggtcgcacaacagacaggcagcaaggcagggatccaagcctaggggtgggctgctctgaggcaacacccatcctcctaccacctctgcttcctgagtcctggcccctgtttcccatgctttttaatgttcctcgcagtcccagccagggcactcagcaaatgctggttgaataatctttcctggctggtttaagggaaaccaggtttgcagcaggagtgcaggaaatgcgaccccttgaacattccactctctttcagatttctatctggtccaagttgcccatggatccctgctagtgtactgcatgccactccaacaccaggcagtgctatgctgtgtggcaccatatctcacccaggagtgaaaccaaatcatgccctcagggaaaatgagccggttcctttttattttttaaatagcagagaataaagttatg

SEQ ID NO: 260368 - DNA, 685 bp, Homo sapiens
tttaaaagtcatgtgtagatttacttagcttaaaaatggaaaccaggaatatgaaaaaggagaagacatttaagaagacaaatgattacaaaatggtatccattgatcctctgtgaaatgtttgtttgtttgtttgtttgtttgtttgttttgagacggagtctcactctgtcgcccaggatggagtgcagtggcgcagtcttggctcactgcaacctccgtctcccgggttcaagcaattctcctgcctcagcctcccgaatagctgggattacaggcttgcgccaccacgcccaactaatttttgtatttttagtggagacggggtttcactatgttggccaggctggtcttgaactcctgacctcaaatggtctgcctgtcttggcctcccaaagtgctgggattacaggcatgagccaccgcacctggcccgaaatatgttttttatgcaattgtattatgctcagtgagaaaaagaatattctgacttgaacatatgcaaagtcaaaactgtggaaaggaactaactacagggctattggttgtatttttttttttgaaaattacttgaataattgttgattccagaggctttagtaaagattatattgagacagaaacacagtttaaatcaagcaatcggttatctagggatgcgcctacacagtgaatgtatcaaaca

SEQ ID NO: 260369 - DNA, 469 bp, Homo sapiens
tactatctccctaagtggatgacaaagttttcaagggcaaggaccatgcctttggctgcaacacctagccagtagtcagcacacaaggtgggcgatttactttcattattgataatgatgatatattactgtttccctgaactaaattatgtctcaaaggtctgagcatatcagtggcatttccaaagcaaagtcatttattctcagggaatgacttatactttgcggaactgcagctcaaggagatagaattttatttggaggaagaaatgcactgtgtcaaaactggaaaacttaaattggctcctctgattttatttgaagctatctgatttgtaagacatatctaagagagtcaagctgctctcctggtttgagttctgcagtcatgcatttctattgcatttgctgtctcctcctgggtgtcaactagctaccagctaatatatattctagaaacaaaagcaag

SEQ ID NO: 260370 - DNA, 356 bp, Homo sapiens
acagtgaaggttataagacacgcctgagcaggcctgggctgtggctgtctgggtgccatagcaaagttatgagataaaccagtgcaaggctcttttgagcaagtctggataacagccatctgggctgcatagcaacagtcacctgtcacaatttgattaactgcctttgttttgcctctgtatccttgcttttgtgccactatgctttataccactgtaagcttgtttcaagctagcccaccgccttttagaagtgtgtaaaaaagtcaagtgctgtctttgttctgggcccagttttcggatgttaatctgctggttctgagtgcactcaataaatcctcctatctcacccccac

SEQ ID NO: 260371 - DNA, 486 bp, Homo sapiens
gtcaaacacctgaaaaaagacacaagtcttgccctggtggattacatttcctttcacggtctatcaatctacattttcccaaactgtccatttctggaacctacaaactcaagagagtccttaggaatctgggcatcaccaagatcttcagcaacgaggccgacctctctggagtcagtcaggaggcacccctgaagctctccaaggctgtgcatgtggctgtgctcaccattgatgagaaagggaccgaagccaccggacccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggataacattaaagaaaggctgaattgccctctgcctgcg

SEQ ID NO: 260372 - DNA, 724 bp, Homo sapiens
cttaagacaaggcacaaatccttttttccattaatcaaaactttacagaggatataagcagtaattttatcattcattcaactggtttgcacagggagagggaggccagaagtctgactggtaagaacttttgcccttttcggggcatgtcaggcttctgggttcccttcccctgagctcatttaagctaagcagtttaaagtttggggatcttaacttttccccatttgaggatgcatctaagggaagtgtcctgtagtacaggacacaattacccatccacgaagagaagacagagttcgaggaaaaagaaggctttttttccccaaaggaatcccagtgattcaggaggcatttgagagaagtacagactgaagatgaatggctacccatctagaaagaggggaggcatccctaggtcctttctcttcctagcaaatacctggggtacgtgagggagagaaataatggtgtcccattctttcttctgtccttatatccccgagtcctgggcaacctcggcagggtgccacccatgaatgccaatgcaacttttcacccatgttaacagggaggcctaatgggtgggaattatccacatttacctacacgcagactccttcctgctgtggtaacttttgagttccctataccttgtctgtgtcatagatactagcatgacctctatctatgaaatgggagggggcctaattgtcaggaatca

SEQ ID NO: 260373 - DNA, 158 bp, Homo sapiens
taatctatctgcttagaaaaagaataactttgttgcatattttaaaatgtgaaactctgagaacttgtgtgtaaatattaaaatatactcagataatttcattatattgaaaattcttattactgtattgaaaataaaccaatgatgaatcctttagt

SEQ ID NO: 260374 - DNA, 421 bp, Homo sapiens
agagtctgagaagcactgctttagagcacctgttacagggaccctggacctcaagaggacttgggatcgacctccccaccaaactgactgaggactgtgtattctgctgatcttctgcatagcaacagacctggtttaccttcagagactcatcaaactatctgagagaatgcaattcctttaagatctcttttctctgtgtgtgtgtttttaaatatactcttgcttagagaaaaccatcagattggttctattacactcagatttaagatcaaacatctttttttcagagctttatggattctaataacaatagaaagtactgaaataagcctattttcgtggctgcctttcaatcagtatgtaacacactttccattttgtcttcaccagaaataaattgtactttaaatctctgctc

SEQ ID NO: 260375 - DNA, 442 bp, Homo sapiens
gacaattgtaagtttgcatgtattctttttctcctaactctgtttagactttgtattcaggatagaaattaccttttctaagaagttttaccaagctgagtgtaaatctataatacctcagcagtaaaacaatcccagagggataattttgtgcaaccatttcaatcttgataccaattaaaatggtatgatctatctcaccgccatcacacaaaacaggtttctatgccatctcctcacctcttgcttagagaaaaccatcagattggttctattacactcagatttaagatcaaacatctttttttcagagctttatggattctaataacaatagaaagtactgaaataagcctattttcgtggctgcctttcaatcagtatgtaacacactttccattttgtcttcaccagaaataaattgtactttaaatctctgctc

SEQ ID NO: 260376 - DNA, 423 bp, Homo sapiens
aaagatgtcacttgacagaagcaatgtgtgccattccaaagctacaacagtggagttggtaggtgtgtctgggccaaacagtggggctggacactgggtcggtggcccaaaaagagtgctaaatttttgctgcacatgtgtaaaaatgcagagagtcatgctgaacttaagagtttggatatagattctctggtcattgagcagatccgggtgaacaaagcacctaagatgtgctacaggacttgcagagctcacacggtcagattaactgatacacgagctctccctgccacatctagatgatcttgactgaaaaggtacaaattgttcctaaagcagaacagaaagttactcagaagaaaaggatatcccagaagaaactgaagaaacaaaaacgtatggcacaagaataaatttggcata

SEQ ID NO: 260377 - DNA, 1051 bp, Homo sapiens
ggttcctgcagcagccactgccctgcccaatccctcccataccccaccatgttggtgggtacccccaacctgctgacactggatgaagctgatgccacctggaccctcatcaaggataaggtcatcgaggagcactttgggcccaatgcagtagcagtacctttcctgtcagatgcagcctgctatgacctactgggtgtgctggtaaaacagtcccgcccagcccatacccgcctggctttgccaggtcggcagggccggagggcactgaaaccagtggggccactaccaagcctcctggagcaggcaggatctgagggtgccttcgcccactgcactcgggaatactcaccaaatggccgagcagagagagcctatgaagagacgcgaatgttggatggacagccctgcaagatccgcctacatatgggtgacctgcgcaagaaggttgccttcctgttgctgccaccagggcaggtgagcctacagcagactcttccctggctccgaagcacccacagcatctatgtcatctaccaggtcttctcttgttcctggctgcagctggggctgacgtctacagcccgtgagccccagctcctccggctacttcggtcattacctgttgccttctcctgcctcaagttttcactgcagtctaagggcgtgctgggaccacagaagcctctcactaaagacccattgccccatggggccaactgggtcagacccaacctcagcatcatgccgcctctggcccccacatcagcatctgctgatacaactgaagctgctgatgtgcccccacctgtcccagccccacctacgccacctccccaggaagggccagaggacaaacccaccagattctcctacaagggccgaaaccccttctggagggggccccagatactgtcagggtctatcctcagagttcgacagtgacgactgaagctgaagcaaaagattccgggggcaaagcccccaagatctggcataggggtactggtctctaataaacatcagctgctgctcccccaaaccatcctgg

SEQ ID NO: 260378 - DNA, 383 bp, Homo sapiens
acagcaattaagccttgctttcacagccgctgaagcagaccaacagatggttgtttaattgtttataaaaccaaacattaactactgggcttggcaacgtatctcttctcctgaagcctctcaaagcagatatcagacaacactctggaagatgctgagaaacatcaaaagatcaaaggtcgaatcttggaattcagatctgtcattgacctgccttataacttctgtcaaactgcaatgtggtgagattgttcacatgtttcacagcagtgttgcatggaatgactaatggccttcagttggttcctgtgtagatggtaaaatggaaagctgttcacaaaacccctttctagcaaagatgcgtctctgccaagtcacatatg

SEQ ID NO: 260379 - DNA, 250 bp, Homo sapiens
tcatgtccggaaacacttggtgaaggctccaggatggaatgtgccagtccaccagcagggcagccccccaggactgcatgactctccatgctgtggatgagaacggctgtacttacgtcacccttcctgccccttcagcccttgttttaaacactctttcagaaatcagagctaaacaatgcagaataaaatatttgattatgtagaaatgcttttaaatgttttaaagtaggaataaaaacaacaaaat

SEQ ID NO: 260380 - DNA, 222 bp, Homo sapiens
aggcctgaggttcattctcgttctctccctcttccctttccccttcctccctcctgccctcgaatctgcaaggtctctccgggtggctgtgttctgccagggcctcccaggctccaagatcactgccttcagggagcccaggaagagctgcacatccgctgcctctgtgtggcaggcgtgtccgagactgcaactcctagttcccacctttcacacctcatc

SEQ ID NO: 260381 - DNA, 549 bp, Homo sapiens
ccacacttttatagcttttcaatatctcacacaatttgattgtaaaaataatgcttctattattgtgatgaatgcaattagtgcttcatgaaagttttccttgaatatgtatccatccttcttaaggataatccagctatgttcagctttacagaaagaatatagtagaaccacttataacattcagacagaacagtgatacgtgaatattttccttgagaagttagtgctgtttcagtttttctctgacggtatgccttatcaataaacaataaataatgagacacatgaccggttcctctctatcagcctccttctgaatctcttcattctgagagttctgcccataaagttagtcttgcatttatttcttcttcttgattcccaaggaatgattcagtagtacattctgtgaagaatgtaatacttggccaggcacagtggctcacgcctctaatcccagcacttcaagaggcggaggtgagaggattgcttgagcccaggagaccagcctgagcaataaagcaagcaagacctgtctctaccaaa

SEQ ID NO: 260382 - DNA, 707 bp, Homo sapiens
gggcacattggtcctgtgggacaatttagcttctcctttggccacatagagccaaagattcagagacatgcctgtgtcagtatggcatggggccctgatgattgtacaaaacacatgccagtggatccactgggtgcagccaccatccagccaggggatggcatcttttgactgacactgaacatggtcattctgcccaatgggacaaactacatgaaatgatagtagccatgcaggctgcccccaacactatattttgctccatttccactaaatcatgggccattgccaacagcccagctgtctggtcaggaaaatagcaactgagtgactgaactattaaaggatctcatgagtggagaaaaggactatggcaatagcttgcttcctggacagctaaatatatgtcactctattagatgctggggctaccatggccacccttgagaggaatttatgtcatgtttttggatattccatgagacttcactctgaccaagaaacagcctcactgcccaatcaacataacaatgggcacactctcatggaaacaaatggactttccatgcaattaccaacacccaacactggctgctgtacctggataaacacctcagatatcctagaaatacaagtaggggtgatcataaagcaggctcactggctgcagacaataggacatcaaaagatccccctttcacctctta

SEQ ID NO: 260383 - DNA, 577 bp, Homo sapiens
ttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatgg

SEQ ID NO: 260384 - DNA, 698 bp, Homo sapiens
ttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaa

SEQ ID NO: 260385 - DNA, 419 bp, Homo sapiens
cacccatgtgaacttaattacttctttaaggttctgtctccaaatacagtcacaatctgaagtcttgggggttaggacttcagtatatgaattggggtgaaataattcagcccataaaaataccattgataagagctcgaaaaatgaaatacttcaatataaatctaacataagatgtgcaggatctgtatgctggaaactacaaaacgccaatgaaagagctagaagaagacctaataagcgaataaacacacagtgttcaaggattgggaagtacagtatagttttgttttgttgttgttgttgttgtttttgttttttttgagacagagtcttgctctgtggcccaggttagagtacagtggcgcgatcttggctcaccacaatcctgcctcccaggctcaagcgattctcctgcc

SEQ ID NO: 260386 - DNA, 519 bp, Homo sapiens
ttactgagaatagcatcatggtgtgttttagaaggagctagaaagttgtaaatctcaaattatccaaactaagccaactaaatattaaaagtcaagaataattttcaatattctggcaagtacttttgggagatttcattttccttgtcataaaagcattaaacaggaatcagatcagacagttcagcagcctcatatctgacttagcaaatagaacattttcccagatctcgtctgttttattgttaccatagctaaacctgagccccggcattgggattggcatcttcaaccacagcttcataaccctttagcctaaatgctgatgctcatctttaagcaagtcccccggactggggctgggtgttgcggtccaattcatgagaaatgatttggggttcctggggttttctgtgggtattgaccaaagtctctttttttgtcctgttcctttgtaacatatgcaacttataggaaggtggagggagaatgacaccttggggccacttagccttgtca

SEQ ID NO: 260387 - DNA, 254 bp, Homo sapiens
cgcttctttcaaatttcctcccatcagtttggctaaagaaaggaatttttctcctttagaaatgaattggcttaattagtaagtagattaatggcaattgctggtgagttggtttccagcagagtttcaccagagagggttaatcggagtcaggtctggaatctttcccagaactggctgccagccatttccaccaaccaatcaaccctacaagaaacagaggaaatgaaataaaatttgtattctctgtgcca

SEQ ID NO: 260388 - DNA, 359 bp, Homo sapiens
ttttttttttttccattttagcagagccaaatgaagattcttcaagatatggtatcttttcacttggctgtttctgcctgggtgactcagaggataagtatttgggaaagacatgaatggtagtgccagggtccaccagcccagaagcattggacgcattttatcataggaccatgagttggacaaaattttataggtgagaaaaaaagaaatgggctggagaagggagactgtcatctctcttggcttgctctgtctcctcctctcacccatcaagtcaagggaaccagacgcccaaagccaagttcatcagtccctccatcggcactgaaaaaatccatcagtgttcataagctgct

SEQ ID NO: 260389 - DNA, 401 bp, Homo sapiens
gcacataaagactttttaccaacagaaccctccacaaggcccctcaagggggctattcaaggctgtaaccttgaagagaccatctttgtagtcaactggatgtgatcatgattgacaaaatgcacacaccattaatttcaaatgtgatactttgtgttataaaaacatatatattggattttaagacattcgcactctgattacaaatataaaaaaattgttataaaagttggagaaaaacagaaaagcatgaataggaaaagaaagccacatcatctgcatataacaactgctagtaagttgatacctatctttcctgtatatgtgttcatctatgtgtgtgtacaagtatgtttgttaatagccccataaaagttgaatcatatttacacatttgattg

SEQ ID NO: 260390 - DNA, 905 bp, Homo sapiens
ttttctttctttttaatgttacccatccttgcaggcgcacagcggtatccatggatttgatgtgcatttccttgatagttaatgatgttgagcatctttcatgtgcttattaactctggaggtagacctgccaggccttttctaatgagggacaaccatggctttgtaccccaagaacatttttattgagttgctttgtgtctagatcattaggagaattaattaatactttctcttccaatgaagctcagctgcgtcctacatcgtgaatgaaaggctttctgtacatttttccaaaaaaaacctaggactattatggataagaagtgacattatctgagcagcacttgaagcaagagaaatacatactctgatgcattatttcagtctaaggaagtggcctgccacgcactctctctctctccgtgtgttttaatctaatatagcacaacttgtcgaagcaaatctataatgtatataaataacagaacagtcttaggtcctcatgaagagcgaactgacttttttatgtttaaaatcttaaatactggttaagttagaggtgagattaaaaagtgtaggaaaatcggctgggcccggtggctaatctcagcactttggaaggccgaggtgggcggctcacctgaggccaggagttctagaccagcctggccaacacagtgaaaaccagtctctactaaaaatagaaaaaattagccgggtgtggggcgggcgcacgaagtcccagctactagggaggctgaggcaggagaatcctttgaacccgggagacggaggttgcagtgagccgagatcacactattgcactccagcctgggcaagagcaagaccttgtcaaaaataaaaaaaaggtgtaggaaaataaactgtcatccagtacagct

SEQ ID NO: 260391 - DNA, 4237 bp, Homo sapiens
  misc_feature (2182)..(2182): n is a, c, g, or t
  misc_feature (3730)..(3730): n is a, c, g, or t
aatcaatatctgattgttagcaacagaacaagtgattgtgtggcatgcactataatcaattcaggatatttaatatagaatatgtgttatcacatgttaaatagggcatatgtttgaactttttaaaaaaacttttcccctaagcatttgagatcagctgaattaagctgctaatcattattcccctttgatctcattccttggtccaagtcctgagagagatactgttcctcttaaggatacttacgaaataatgacatggaaatattttgcttgtcacagtatattgcctgttttaagacctacttttaaaatcaaataagccataaattcttattgtaatgccatacttttaatcatttaaactaaatgtttaatcagaagttgtctaatacaaaaactagtcaaaaagcacgtgaaatgtatatactttaaccaagaaattctaaaaattggtttctatagagaaaactggacagaatgacaatgtatgtgacacaaaggtgtttaccacagcattttttatcacagtaaaaaatagtaaaaaaaaaaaaaatcacaagctaaatatcaatggagaattgattatagtataatataaaaatgatcatacaatgatcatatatacatttttcacttatatagtaagttgtccatgacttactggttaaaaaaagtgataaaactaaatatatgaatatcaaacaaaatacaaatagtgcttgcatttcggtggtagacttttatgtgacttgtactctgtactgaattgctaaaattttttacatcatattcccttttataagggttaaaataatataataactactgttttcattttgaacagacaaaagtacagagttctgggatacaatacagttcacaaatagtaatcctattttgtacccttgaaatttattagtttattctgaggatacaaataacatttatatatgcacacatgagccatcttaatatttccatttagttcagaatttcaaaaatatcaatcgatccttgaactttcaagtatagaaatgagtttagggtaaaatagtaacctttgaaataattacagtactgtattagatttgtctttttctttaattgcttaacttcatgaactcatttgtttttttctttttaatttttattcatctactttttccaatccccaatgtgattaaattcagaagaacagtatctttcaagtaaatgatgcaaaacttcctttcacatcatctcacgtcctttccccctttgtattagtagataattatactatctacagccagaacgatcttcctagacgtgatcatgctatgtgctatgaaaaaaaccttcaatggggacctccactaccgaaatgatgtggtagtactggcagtcgctcccaggtgcagtaactaggaaaaaatggatcaaatgcaaaatacattacagatacgaaagagctgtggaagcgcttaagactagatgtactaaaagtctttgtcttttctacatagctgagactaccaactgttttctttcctggcatcatttgccaattctaggcatggattaaagatcaggctttgtgtggactaaagcactttactggggaaaatcagcaggacttttactgactgcatgatctatcatgatgtactagaatctagaggagccctaaacccaatactgagtgagactagaacttaggggctaggcaaacaagttttcttaacaggccaataccacctctcaatgccaggcttcttcatatcctattctttctcccatttcctctcttgtatttggccacttctatccttttttcccccctcaggactctgctatttatccttcacgaaatccatccataaaatctaccaaatacgcaccacagaagctttctacaggcttatctttggcataatttttatttaacaacctcttattttccttgttgtatcctttcttggaagtggagtctttaattatctccagcacataggaagtgacctgagtgctgaataaaaaataagcaatggaatcgctacattaaagatgcttacaaacttttattatcaataaaatctataaattttacacctatcaactcagaaaaattcactgggaggagaaaaactattaaaaagcctaacttcaaatgaactcaaactttcctgccaaatcatanatatgaaaagtaaatcatccatgtatgctagaggatctctctgggagaagtgtcctacaatttataacattttacaagtggttaaatccattaaaacttcaaaaacttttagattgtctttctcctgtaatgtgatatcttccctaacttgctaaaactgagaacccagctagctttacataactgaaatgattgaatttgtttgcctaatacactaatatttgattttaatgaattatctcactcccacaaagtgtcttatgttagctgccttcatacgtggccttttaatcatccacatctaagaatactgagatgcaaaaattgctcagagtccagatgataataaggctaagtttatttctaggcacaagcatttagaacaaactgcctgcaagggacaaatttaccgccatgggccttttactttcacttggtcttacagctgcagaatccatccctaatttttgtcaactgcccattggccttttagaggttcttagtaagaaaatcaatggctgaactaactactgcgaaaactgaaagcacattatcttctcatggtaattaagtcatttaattaatattaggaaataaaggaataagcactaataaatggccatttagattctgggttttgcgtggtgacttagatgtcttcagtttcatggttaagagtgtaaggactttggaatcagtttctaattttaaaattaaatttcatcatttgctatctatgtgaccctggaggcaagttatgcccctttcctttgcctacatttctccatctgtaaaatacaggttatactgtaaataatcatggtgatgttctgaagagaaaagctatcataagcacttagcaaagtgtttggcacattctaattatgcaacaaaagctatcatcatgtccacagcttcaagttacctcttgtaactaacacttcctaaattcctatggctaaattacaaatttctactcaagtgaattaagtcctgtgattagacacctactttccctgaaggttttaaaattatcttcagattctggctttcatttgtcttcccaatggctttctgttcccttaaatttgtcctccatctctgcccccaattactcagctctttcctacagaggattttaagtagctttactgggggtatggtagaaagagaaaggggacttgaaggaatctttaaggcatcaaaaatagtctaagttggcctcaaatatgaactgagtagtctgggctcaatctgttactggaattcagctttctttagtaggaagcctttgaaggttttacataaaattataatgatcccatttattactatcagcctaaagaaccatttaaaatttgtgaattttcttgacacaatttccacatttttctgtaccttaagaatgtatcatgcctagttttatcaatcatgttttatcactgatactaacagaatcaagggtctgtggtacatttattttgcttttgcccatccagccttccttgcccattctggaaaaagaatgttttcaataaggggacccantacagatggtttgggtggcacactgagtatttagcaggtgagcctaaatactcctttattggatttacttattcccatgcttgtgtactgctacttacatcacaatcaaaagcagggattaccagttttttgaattaaaacaagatgccctcaaagttcagagtgctatgaatgttgcaacctcaaagttagctagtgaatttacattactgcctattacgactctaaatcctgagagccagaaaaggcctatgagcctcagatcttacaaatagcctggagtacttcttgaggatttgtaaacattccttggactcagcagtcccttgagaaaatcatttcctccaaaatctgtgtctatattctctatcttgtttaagctctccctccattcccaaacctaggaatcatcctaaattttcatctagaccctaattcaagatcctcagtctctcttctcttcctactgcttctgctgtatttcatgccctcatcctaactggtctg

SEQ ID NO: 260392 - DNA, 491 bp, Homo sapiens
caggtgctgtcagtgatgtgaatagtttttaagaaaatcatggagactttagttaatggcctgactcgcccaattaccaaagaagcttgggtgctaactacagaaacgtgggatgacctctttctatcagggtttgaaaaggcaggcttagccacatccaactacctcctaaaataggatcataactattttacctgctagcccctaatttgagggtaagggactgatatctctttgactggaaatgaggatatgatttcatacttctttcggttctatagtaatggaatccacaaagctgaccaaaatattatgttacccaggagccccagactcctaccctgtcaagacctttgtcagaaccgctgaaaaacaagcaggagagatttgagttttacttcctcttccgtgccctggaggtactaactagcaaataaatagctcagctaaagggataaaaaagagaagcaagggtcttgtgtcatctaaat

SEQ ID NO: 260393 - DNA, 1618 bp, Homo sapiens
gagtgcaagatcgttttctcagtggtggtggaagttgcctcatcgcaggcagatgttggggctttgtccgaacagctcccctctgccagcttctgtagataagggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260394 - DNA, 655 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccagggccaagtgtgcctcttgatcccgtaactgctaactggaagtcaagaaactaaaaacattatctcttgtacca

SEQ ID NO: 260395 - DNA, 2388 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260396 - DNA, 1903 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260397 - DNA, 2289 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtatccagcgtctgtgtgcaatttcgttttgagaattccttctaaccagatcaggaaagctctcttaccaggaatagccccaggaaagacaatatggattagacgtactccatgataactggcgttttgcatggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260398 - DNA, 2033 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagaggatccagcgtctgtgtgcaatttcgttttgagaattccttctaaccagatcaggaaagctctcttaccaggaatagccccaggaaagacaatatggattagacgtactccatgataactggcgttttgcatggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260399 - DNA, 2303 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctgtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260400 - DNA, 1180 bp, Homo sapiens
gtgatacaaggagctcatgccaggaagtaagtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260401 - DNA, 1114 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggatttgtaggccttaacctataactttggccaaatgctttcacttgcttatatggagtaaagagaaattctgtgtattcttgct

SEQ ID NO: 260402 - DNA, 1059 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtgtaaggggggccctactgacccttggaatttaggggggctaccctaggcggcatccacaacagagagaattcccttggagaggggaccctggtgctcggctgtccctctcatccgcgtagaaagtccctcatctgggggctcccgaactcagccctctcacattgtggccggctttactgaccctcacagacccaggctgggccctcccgatagaggccagccaaaggttcactcagcctctctttcaaggctggtgtatctctaaatcttagaccctcctccgttaccgtcagccaggtgggatgcccacgttttggagagaaaccgttctgaggaacccgggcctctgggtcccagctggctctccggcccccaggttatgtattctgggttggccacaaacagtggaattct

SEQ ID NO: 260403 - DNA, 775 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaaggtaaacatcatcatcttggtcttggccttgcggctttcatcctccaggcagttggtacacttgccccccaccacggaca

SEQ ID NO: 260404 - DNA, 434 bp, Homo sapiens
ttcaaccaaccacggactgaaattacagatacagagggctgactgtaatatgccattttacataagggacttgagcatccgtgaatttttgtatacatggggagtcctggagccaatccccgactgatactgaggaccaactgtgttgctaatcaaattgtacacaattatatactcttacgaaaatgtagttaactattacagatccagcgtctgtgtgcaatttcgttttgagaattccttctaaccagatcaggaaagctctcttaccaggaatagccccaggaaagacaatatggattagacgtactccatgataactggcgttttgcatgtaggtaactgtggaagttttaggagcaactggtttctgccttgccagtctacttaagtatgtcagatacttgatagaattgtgtttttcttgtttccag

SEQ ID NO: 260405 - DNA, 2159 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260406 - DNA, 2518 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggatccagcgtctgtgtgcaatttcgttttgagaattccttctaaccagatcaggaaagctctcttaccaggaatagccccaggaaagacaatatggattagacgtactccatgataactggcgttttgcatggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260407 - DNA, 2099 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccagggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260408 - DNA, 2728 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtacagcagaccgaggacacggttgttaccaagaccaggctgttgccttggaagagcccagagcgtgtcaagggagacagccacatcacgccagaaatacatgacagctggattagccctgggagagggaggcccagatgtgggagctcaggggaggtgcagctcaacgtggagtttggaggaggctaccttgacctttgaatgccaagtgggagccagccagatgaaaggggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagctataaacagcattcagcacaacactcgctccaatgtgattttctacattgttactctcaacaatacagcagaccatctccggtcctggctcaacagtgattccctgaaaagcatcagatacaaaattgtcaattttgaccctaaacttttggaaggaaaagtaaaggaggatcctgaccagggggaatccatgaaacctttaacctttgcaaggttctacttgccaattctggttcccagcgcaaagaaggccatatacatggatgatgatgtaattgtgcaaggtgatattcttgccctttacaatacagcactgaagccaggacatgcagctgcattttcagaagattgtgattcagcctctactaaagttgtcatccgtggagcaggaaaccaggtaaattgcttaccaaacacccctcttcctacaatattgtttaatgggaagaggttgcaaattcagggaactcttttgctgcaatttacactccccaatcatttcatcccaaaactcaagcctgcttttctgtagacttcttcatggacttgacagcctaattgttcttgaacatctggtttattatgtcaacatctaggttcctattctaacttggaatttcaaatatttattttctaatctgaagaagtcagtttaacagctcttctctctactggctataaaattgtatctattttgtttgaagcagtaagtacatatatcctatttgtgtttttagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagaagagggactgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260409 - DNA, 1130 bp, Homo sapiens
agtctccgacgggccggtacagcccgtgtccccgccccgcgccatcgctaggcgacgtgcgcttttgccgcgccgtgctgcccgcgagggcagctgaggtggtggtggcggccgccttgtcgaggcatcgcgcgcccgtgaagtgttcgccgtcagtgctgttgggtgcctggagccgcgtcccccgtcccgaaaactgtccttgacagtacttgcgcggcccaacggccgccggcgcccccgcgtctccatggcgacggcctttttccctgcgaggaccccggcggcagggctgccccgcggcgcctgcttggcgcgacgctctagcggttaccgctgcgggctggctgggcgtagtggggctgcgcggctgccacggagctagagggcaagtgtgctcggcccagcgtgcagggaacgcgggcggccagacaacgggctgggctccggggcctgcggcgcgggcgctgagctggcagggcgggtcggggcgcgggctgcatccgcatctcctccatcgcctgcagtaagggcggccgcggcgagcctttgaggggaacgacttgtcggagccctaaccaggggtatctctgagcctggtgggatccccggagcgtcacatcactttccgatcacttcaaagtggttaaaaactaatatttatatgacagaagaaaaagatgtcattccgtaaagtaaacatcatcatcttggtcctggctgttgctctcttcttactggttttgcaccataacttcctcagcttgagcagtttgttaaggaatgaggttacagattcaggaattgtagggcctcaacctatagactttgtcccaaatgctctccgacatgcagtagatgggagacaagaggagattcctgtggtcatcgctgcatctgaagacaggcttgggggggccattgcagcttcccagacagactatagactataaatatgtctccatctgccttaccaagtgttttcttactacaatgctgaatgactggaaagaagaactgatatggctagttcagctagctggtacagataattcaaaactgctgttggttttaattttgtaacctgtggcctgatctgtaaataaaacttacatttttcaataggtatc

SEQ ID NO: 260410 - DNA, 415 bp, Homo sapiens
ttgaagtgtaataaattatattccagtggcagagaccaagtgacagccagttggacctgccccaaacgcactcacactgagatgcagacgcacaccgtggcgactcgaggggctctgcgaaggcctgctgccaggtgagttacaacaatgctttccaaaacagccgcgcaggggtcaggggtcaaagccacagctcagcacaacacaaaaccctgactctaccacgtgagaacgcgggtgggaagccccagcagctcctaaccaacgttcctccgatgccgccttcctgaaccttccttgcagctggaggggaccgcagtcagcaccagcaagggcagggtcccaggctgctggccttgacacttggtcccagctatatgggctgaagtatttcttagtgtgagagtgtaaccat

SEQ ID NO: 260411 - DNA, 425 bp, Homo sapiens
tgagacagaatctcgctctattgcctaggctggagtgcaatggtgtcatctcggctcactgcaacctttacctcccaggttcaagcgattctcctgcctcagtctcccaagtagctgggacgacaggcgtgtgccaccacgccccgctaatttttttgtatttttagtagagacaggatttcaccgtgttagccagacggtctcaatctcctgacctcgtgatccgcctgcctctgcctccctaagtgctggggtgagccacagcacccagcccatccttggattttgatagccatgaggggtcctggaacgaatctgaggaactgtatgaagctatgagcagaagccactactttaacttgattctcttgctaatattttctttgcattttcttctgtgtcatcttcatacctccacctcaaat

SEQ ID NO: 260412 - DNA, 366 bp, Homo sapiens
agtagtcatacctttatcctgacaagtttttcctcctgagggcctaatttgctaataggaagtaactagcttttgtaaaaaagaaaaatatggaatattaaaatagaacacaggagtggtgcacctatcatccctccccttagattcattcatgatccagaatgtaaaagatatttgggccgtcttactcatttaatgaacaccttccttttctgctcagaatcaatatgtattcgcccaagatgctaagtttatgccagaaatatgtatgttatgtggaatttcttttaaaattcttattcagcgtgtactgtcagttgctttaaatacttactgccaacaataaaatctatttttatgcctatc

SEQ ID NO: 260413 - DNA, 381 bp, Homo sapiens
ttctttctcaggttgaatttagcagcatttgttctttttccattcctgaattaattataactgtaagccttagttaaagtctagttatgtttgggtggtcagatgcattaagaattaatatttttaagtaacaattttaaatgttttggcatgtgacatttcttttataaattgttaaaatttatcattattaagtgatgtccttctgccttattatttttacagtaaaaatccaacttgtgaaaatacagttctcctaagttagagaaaattgctaacacattttgacattggaattgaatatgtatggattaacaaaacaaatattatttgaattccatctgatagctagctaaacaataaaacaaatataaaatttga

SEQ ID NO: 260414 - DNA, 503 bp, Homo sapiens
  misc_feature (7)..(7): n is a, c, g, or t
taaattngcggccgcgtcgactaaataagccatagagtgagtcaaatagagccctttggatctggtttatttcacttcttaatttttaattactgagtagtattccattgtatgggatgtgccacagtttatgtattcaccagatgaagaacatttaggttatttccagtttttgatggttatgaataaataagcagtttttgatggttattttcagtttttgatggtttttgatggctatgccataactgctgtcaaacattcataaaacaggttgttatgtgaacgtaagttttcatttctcttgggcaaatacttagtggaattgctaggtcatatgaaaagtatgtttgactttataagaaattgcctaggccgagtgtggtggctcatgcctgtaatcccagcactttgggaggccgaggagggtggatcacctgaggtcaggagttccagaccagcctggccaacatggtgaaaccctgtctctactaaaaatacaa

SEQ ID NO: 260415 - DNA, 159 bp, Homo sapiens
aaggcatggaagaacacttccagagaaccagctcacaagtgcaaggggatggggctgtcgaccccgtgtgtatagtgccaaggcaatccaggtcatggttgcagagtgctttactgccatttttattgcctcctttcaataaaccactgcagtgcatga

SEQ ID NO: 260416 - DNA, 169 bp, Homo sapiens
tggaggaggggcctggtgggaggtgattggatatggggtcatgggggcagatttcccccttgttgttccagtgacagtaagtgggttctcatgaaatttagttgtttaaaagtgtgtagtacctccccctttgctgtattctccttctctggccatgtaagacgtgcct

SEQ ID NO: 260417 - DNA, 556 bp, Homo sapiens
ggcaagaatgtgttgatagtcagaagggaaaagaccacgagcacccctgactgcaccccaacgtatactgatgtcatcagcgagaccctgtgcagcatgaagaagcggaaagacaacctcaatcagttgtaccagcatcattggactgaatggaattattttgacaagcatctaaaggagctgcaagacaacttctccagggaaatgaagaatattgatccaaaagcagcagatacaaaaaaggcaaaccacatgttcatcccaccttcagccgtcaatgaggaatcacctgacaagaaaactaagggaagtctccaaagagaaattgagtttaagggttgttcgaacaaaaaccatgggaaaggtagaagtgtgaacatgaggggaaaggaggagagggaaagagaagagaaacagaagttgaacatttctttccactcacttccaagccctgaggagctccacaacctagaaccaggaagcgcctacagaatccgtgatatttctgctacgaggtggagtggaacaagaaaataagaaaattgtggccaaagac

SEQ ID NO: 260418 - DNA, 389 bp, Homo sapiens
cattttaaatggttatataagtagctaaataatattctcagttttgcctcttggcctgcaatgtctaaactatttactttatggccccttaagaaaaagtttgctgacttggagacccctggggactttgaaggcatccactgggcatcttggaacataaccaccgaggataagggggcactactttgttagactccacagatgaacaagggtcagttgtccacactgaccactgtggccagcctggatcacatgcctgccctgcagtgaaatcagcaggacactggactcacctgggtcacttaggatggaaaagaacttctccaagtgaaccagaagaaggggaatgcaaaaattctagaataaactgtaactacatattccagtct

SEQ ID NO: 260419 - DNA, 492 bp, Homo sapiens
tcatttttgttttgtgggggtggtggtttaggtgttaagggtttggttgatatctgtagaaaatttcttaatgatctacacagtagataaaaaaacaagttaaggtcaaagacaattccttcgtctgttttgggagacgagtgtgtatgtttgaaaaaaaggtttgttctgggtcactcttctttcatccagacgcattaaaggaattagaagggggtctccctgccacccccgaaaccgtgagagtcaaacggagattcccttatattcctgctctcaggtgcgggtccgagtgacaagaacgttcacgtatcttcgggagagaacgaaaaggtgctcgggtctggcgggggcggggaacgccaggggttggtgggaactgaggggcttccggttcccgggaagcggagtcccgggccggccgcgggccgcgggctacgcagggagcacggggccctcgccgcccccagcccgcgctccttagcgttccct

SEQ ID NO: 260420 - DNA, 202 bp, Homo sapiens
gaaaccatataaagaattagattttgctctggcactgctgaacatagcatagtgacaccttaaggcaccagaaagtactgttcagattggctagctagtagctccagcgtgatccctgtttgccactttaatgtccagccttgttttttcatattcccttgagcttcaggtagccaaggctagaaagatatacctgtcactg

SEQ ID NO: 260421 - DNA, 365 bp, Homo sapiens
acaaaaaagaaatcataaatttactccctgacagagctatacaggttaactgaaatatcacctttcttggcttttggaatgtggtcatcctggctatcttttgttaatcggaaggtcagatggatggttttctgtgttttggattagtagaaaattagaaagcaaataatatattcaacaccttggcagacaaaattgttaaaaattgtgtagctaaaaaaaagcacgttttttggtggtgagactggtgggtatccatggctctgcccccaggagctcctagacaagcaggcacagtgtttccagtagatgagtacattcttaagaaagcagatatctttttttgccatcccccacctcctgca

SEQ ID NO: 260422 - DNA, 1347 bp, Homo sapiens
gccgctgagcgagggccctcatgagaagggaaggtcgcgtggacaggctgccaggggcaagcgtttttagattacttcctccttcttggccccagatgcacttggttgcacgctctggttcccaaacccccggccgctggcttatgcaaatcacttaggtacatgcaaaagtatcccttctcccggagcgccattggcccggggaggtctcgagctcattactatgcagagaggagagccgccattggccaagaggaggaccagaggggcgtgtttctcgggcaaattggatctcctaaattggatgacctggtaagtagaacttccctccagcgttcagttaagttttaaatgactctccgctgttccaaagggcgaggacgtctggagctctgcaaacggaaaaaagatttgaagaggaggaaaaaagtttccctcgatctgacacacatctttgggttttagctatacactaagttaaaagtgtaccctctccagtgcctcacttcacctggggatctttacacctatcttggatacacatttggtagctaagtcttagcaattcattctccccagtcctctctctgtatttggtgtttttggtgactgcaaattagactcctttctcacgcactttaaatcctgaacacaggaattttgtaaaaggtcagagaaagtgatgtttctgaacactggacaatttccaaaacatctgagtgggaggtgactacggctgagaagccagcagcaacgttggtgttagggctgaaagacaacttaaagacccccagaaaactctggttttatagataagaaatctgaggctcgagagagagtgttctgcccaacatcatcacggaacagctcctgggctcctggctcctaatctgagcacacaggacttgttgactgatggataagctggacttcggttctaccacccctttacccaagaactcttgtaaacatagaacctgaacaagtatatgcagaggccctacctgttgggtgaacggttcaaggtgccctgttacaacaacagctcagatacagtgggggctctgagtgctgtaatgattgactggataaaagtcctcaaacatgtagaatttcactttttatgaactatttcgacttagaaaaagagttaacagcaatcagcttaagaaatattacgaatgtagttgaagctccctttgtaccactccccaatcatattccttttcttcctctccctgagaagtaagcagtttcctaaactttgtagttaattcccatgcatattttcatgcttttcgtatgcatgtatccctaaacaataaacagcattgtttttcatatata

SEQ ID NO: 260423 - DNA, 977 bp, Homo sapiens
agagaaagagagggaagtggaagaaatagtggaacttgccaaagtgtacaataaaaagaaatttcagtcttaaaagcagtcagtacagaattaatctcagcaaacaacacgattaagaagctagataatattaggtaataaggaaaaaggcgtacattgtttctatcaatgagaaaacaaaagggcagaaactctgaaaagaggggaaaaaaatatttgttggaaagttgaagtacaaataggaacctaaatcaatggcatgatttttgagcagtagatacagtataagaaaaagaatccagtcaaacttagtacttaaaacattcttctttgagcatcacagtttccttttctgtagtcacattctctgcaataaacaatatttacaaataatgaggcaatgctgcaaataaacccactgaccaatcagaaaaatgatagttatagaagaggaaagtagaatcaaaaggcagggagatgagatgccaaactcaaatgcaaacaatgagagcggaatctgaaatacgagatgaagccaatacccagaagccagacacaggataagaaccgaaccaggttagaagcaaagcagagggcttcaaaatgatttcatcttaccaaaggatttctcttcgtagtgacaaaaatgttttctaattattgcctgttatgttggattgtttcctgtttgctttgtcagtttgtgaattgggatctcatgaatcatgatcatttcattgtaatagtagcatcaactaggataggacaatttatgtcaaaaaggtcggtgtaagacatattcaaatactttcatggctgtgaacacttaatataataaagaggttcttgcggacaggtgcggtggctcacacctgtaatcccagcattttgggaggctgaggtgggtgaatcatgaggtcaggagttcaagaccagcctggccaagatggtgaaaccccgtctctactaaaaataac

SEQ ID NO: 260424 - DNA, 1015 bp, Homo sapiens
agattaggagaacatatgtatgataaaacaattagactaaaaaggtcctttctttttatatgaaatggcagaaaagcaacagcagtttattgcttatgacagaatacatatgatactcgaatatttcttgagatctttgcttaaatctagtatctatacaaaatttttatgttcgctagattgtaaattcagttttcttactaagaaagactgaaatttattaataattttggggttctagtgattagcattagagactgatttgcttttaaagagaatcgcatattttatatatttccaattttacatacttctgaaagaacataactttgtcattaatatatggcatatgtatacaatgaaaaatgtacaaggatgtttcttacagcagttattgaaatagcaggaagaaaaaggtaacttaaaagacacttagcactagagtctccagtcacatctactccctggcccatgaactaagaacgtttttaacgtgtgtatgaaaggagtgacttaatagatctggcgtgttgaaacctgcacctttcaaagaaaggtctagccctcaacttgctcctgggagatcacagcgctaagcccctggaatatcctgcctgatgcaaggcctttgtttacctggggccttggatcacaccagatagtttatgctacagatttatggtgagggcattgcaccttgcagtatcaatttaatcgccgggggaggtggaaactgaataacatctgccatttctgttctccatgcctatgtgactaacacccaataaaaaccttggacaccaagtctcagcttccctggttgataatatttcataaatgacccacactcattcagagaggattaagtgctgtgcatgcatctcctgtcagatgggacaactggaagcctgtcctgctctcttctgaactctttcctatctgccttttaaaactgtactgattttaaactgtacttttgctctaataaactaattgtcaacgtaaaaaaaaaaag

SEQ ID NO: 260425 - DNA, 141 bp, Homo sapiens
tgagctgccattcccctgagctccacaccccacacccctcacccctccagaaggagctaagggcagattctcctcccttatcctccaagaagtcaggggcttcttgctctgtttgaaataaaaagcaactgcgtctgcgca

SEQ ID NO: 260426 - DNA, 1450 bp, Homo sapiens
gtttcagcggccgctgaattctatgaataatcagaagtcagtttggggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcatcgtcttgacaatatttgctctatatcttatgtcttttctgttttaaactgtgcctgtagtaatagatatctgtcttgatgaataagtaaaattaggtatgcatttgtttc

SEQ ID NO: 260427 - DNA, 1313 bp, Homo sapiens
gtttcagcggccgctgaattctatgaataatcagaagtcagtttggggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctc

SEQ ID NO: 260428 - DNA, 1321 bp, Homo sapiens
  misc_feature (4)..(4): n is a, c, g, or t
  misc_feature (6)..(7): n is a, c, g, or t
ggcncnngggaaaactctattttgaaaatgaatatattttgatttaaacaatacagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctc

SEQ ID NO: 260429 - DNA, 242 bp, Homo sapiens
ggataggctcagaagcacatgggaggtggggagatttagcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctc

SEQ ID NO: 260430 - DNA, 1539 bp, Homo sapiens
  misc_feature (81)..(81): n is a, c, g, or t
gtttcagcggccgctgaattctatgaataatcagaagtcagtttgggaagatccagttcttataggactattcatcaggtngtttagttcagcattactttgtgctttctgataagatatgatccaaaacctgatggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataacccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcatcgtcttgacaatatttgctctatatcttatgtcttttctgttttaaactgtgcctgtagtaatagatatctgtcttgatgaataagtaaaattaggtatgcatttgtttc

SEQ ID NO: 260431 - DNA, 2026 bp, Homo sapiens
ggctcgaggccaggatgcctccagtctgggggaaaatgcttcctcatttgcttctcccagcccacctcaagcagtctccccaccccttgagtctcagcagtgttaaagctgttactttcacagcttcctgggagcgagtgctttctcaagcccgtcttgcaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgttt

SEQ ID NO: 260432 - DNA, 1966 bp, Homo sapiens
cattgtgttgggtacggaagacgacagaagggtagaggagaaaagcgcatggcccggctagcagtgagcctctcaaaagcagcagggaagcccaagccacaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgttt

SEQ ID NO: 260433 - DNA, 2087 bp, Homo sapiens
ggctcgaggccaggatgcctccagtctgggggaaaatgcttcctcatttgcttctcccagcccacctcaagcagtctccccaccccttgagtctcagcagtgttaaagctgttactttcacagcttcctgggagcgagtgctttctcaagcccgtcttgcaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcct

SEQ ID NO: 260434 - DNA, 2161 bp, Homo sapiens
ttggccagaaggggaatagaaggcaaacaataaaacagcagcccaactccaccctttctgtttgttccttaaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctgccatctgttaatactaaaattcccaaataaggttctgtttagaatgtccctttttatgcttcttaattattagcagtaaatgttcatttttatgggatcctaagctaagaatagatgtaatcatctttattggttttttaaaacacctttgctattatctatcacccatttatacagaaaattgctaagataatatttggtttcagatgatgaactaagtctataccctcttaagaattggtggaaaatagacaattagcagct

SEQ ID NO: 260435 - DNA, 1954 bp, Homo sapiens
ttggccagaaggggaatagaaggcaaacaataaaacagcagcccaactccaccctttctgtttgttccttaaaggtcttccacttcagcacaatgctactgcctaaaaaaatgaagctcctgctgtttctggtttcccagatggccatcttggctctattcttccacatgtacagccacaacatcagctccctgtctatgaaggcacagcccgagcgcatgcacgtgctggttctgtcttcctggcgctctggctcttcttttgtggggcagctttttgggcagcacccagatgttttctacctgatggagcccgcctggcacgtgtggatgaccttcaagcagagcaccgcctggatgctgcacatggctgtgcgggatctgatacgggccgtcttcttgtgcgacatgagcgtctttgatgcctacatggaacctggtccccggagacagtccagcctctttcagtgggagaacagccgggccctgtgttctgcacctgcctgtgacatcatcccacaagatgaaatcatcccccgggctcactgcaggctcctgtgcagtcaacagccctttgaggtggtggagaaggcctgccgctcctacagccacgtggtgctcaaggaggtgcgcttcttcaacctgcagtccctctacccgctgctgaaagacccctccctcaacctgcatatcgtgcacctggtccgggacccccgggccgtgttccgttcccgagaacgcacaaagggagatctcatgattgacagtcgcattgtgatggggcagcatgagcaaaaactcaagaaggaggaccaaccctactatgtgatgcaggtcatctgccaaagccagctggagatctacaagaccatccagtccttgcccaaggccctgcaggaacgctacctgcttgtgcgctatgaggacctggctcgagcccctgtggcccagacttcccgaatgtatgaattcgtgggattggaattcttgccccatcttcagacctgggtgcataacatcacccgaggcaagggcatgggtgaccacgctttccacacaaatgccagggatgcccttaatgtctcccaggcttggcgctggtctttgccctatgaaaaggtttctcgacttcagaaagcctgtggcgatgccatgaatttgctgggctaccgccacgtcagatctgaacaagaacagagaaacctgttgctggatcttctgtctacctggactgtccctgagcaaatccactaagagggttgagaaggctttgctgccacctggtgtcagcctcagtcactttctctgaatgcttctgagccttgcctacatctctgagccttaactacatgtctgtgggtatcacactgagtgtgagttgtgtccacacgtgctcaagcagaaggacttttgtgtccatgcttgtgtctagaaaacagactggggaaccttatgtgagcagcacatcccaccagtgaaacagggtattgctcttcttcttttcttgatcttcctgtctgggcagacttcagagactttgtggcctggaggcctattaagcacgacacagtatcagtggaattgatccataaacctccctgtccacatcttgcccaatggggaatggatctttcaccaaagagctcaccagcattttccacagagatgcaaattctgagcccttggagttcccagtggattcaaggaaggaagtgggaacaaggttggatgcctacttatgagcttgaccatcacagctatcggtaatcagaaatatgaaacaaaatctctgcacaaaagagcaagctcttaagttcacagggtgcctgggctgcatttgaatatcacttcccctctgcattttcccatcacatagaagactttgacctgtgaagctggcaagaattactcatcggggtacgaggccgaatcgtatcatggctagctgttctggg

SEQ ID NO: 260436 - DNA, 663 bp, Homo sapiens
ggttcatggaccatacatttggtagcaacactctggacaggtgctattcaatagaaatacaatgtgagccacacctgtaattttaaattttctagtagtcacattaaaaagtaaaaataaattggtaaaactaatttaataatatgtatataattaacccaatatatccaaataacataatttcattatgtataatatttacagtattagtgaaatattttacattcttttttggtactaactctttgaaatacagtgtctagtttacacttacaacatctatctcagtttggactaggcacatttcaagtgcttaaaagccgtatatgcagtacagtgcaagcccagatagttctgcattagatgtcttgaatcaatgatcactgtcatcctcataaaaatagaccttaattcttcacaatgcatttgaaagtttttatcccacctgttcatagccaattgttcttagttttcaatatgaaattaaacagttgcttagctcaatgtttacttttaatttccatgtaagctacccaatatatgataaattcactttagactaagacacttaagaaacagaacaggaaatagaataatcactggaataggaatctagagatacaaattcaggcccaaaagagttctgcctctatttatttgtta

SEQ ID NO: 260437 - DNA, 451 bp, Homo sapiens
ccgacttccactacgcttttaaaagtttaacgcataaagacttctatgcttttctctaaccgttacagactctgaaatacgaatgaagacaaaccagggcatttcaaaggcgctcggcatcacccaatttcccaaacatctcacgagatccagtttgccttaaaaagtacacgtatatttccaaaataagagcgaggctgggcagaatggctcattcctgtaatcccagcactttgggaggctgaggtgggtgaatcacttgaggtcaggagttcaagaccagcctgcccaacatggcgaaaccctgtctctattaaaaatacaaaaattggctagatgtggtggctcacgcctgtaatcctagcactttgggaggccaaggagagtggatcacctgaggtcaggagttcaagaccagcctggccgacatggcgaaaccctgtctccactt

SEQ ID NO: 260438 - DNA, 708 bp, Homo sapiens
ggaatacagggattatctcatccagccatctaagagaacagaaaagataaaaataataaataaataaataaatagctctgggatgtagtctttctggctaaacagcttccccatgaggaagttgcagcacttaaacttttgactcctgtaggcacagcagtgcatgcctgtagtcccagctactcctgaggtgggaagatcacttgagcccaagaagtcctggactatagtacacgatgccaatcgggtgtctgcactaagttcagcatcagtatggtgacctcctgggagtgggggaccaccaggttgcctaaggatgggtgaaccagtccaggcagaaactgaacaggtcaaaactcctgtgctgatcagtagtgggattgtgactgtgaataggcattgcactccagcctggatgacatagtgagatcctatctctaagaatagagagagagagagagggaactaaacttatcactccaagccaaattccctttcctcacaggcctctcattaatgttggaaaatgccgggtcctctgtacaactttctgtttcctacagttgcctggcctctatttgtttttgtcatgtcatattcctcaactgttctaattggagtggagctgtggtcatctattgttatagtagtaatactgaacattgccatcatttttattaagtgattcttacttgccacagcagtatt

SEQ ID NO: 260439 - DNA, 289 bp, Homo sapiens
tttttttttttgtagaaacaaggtctcgctttgttgcccagactggtatcgaactcctgggatcaagtgatccttcctccttagcctcccatagtgctaggattacaggtgtgagccaccacacccagccaagttcttatatctgtctctaagtatctctctctctctttatatataaatatagatagatagatgtggatagatatacacatatattttaaacctcctttgtctgcacatttaattagttacaaagctgtgtcaatttaggacttgtcttgtatccatt

SEQ ID NO: 260440 - DNA, 158 bp, Homo sapiens
atatcctcccacccaccacaacctcccaccccaacaaaacctgttctacccagtcttctccagctcagtggcaattttatccttccatctgttcaggctaaaaagctcgtccttgtccttaacccctctgacccatgcccaatccataagccaatcca

SEQ ID NO: 260441 - DNA, 550 bp, Homo sapiens
tcatttatttactatcttgttgcacagtggattgatgcaacttacagtaataatgtgaagtattatggcagtaacaacaaaatcaagaaaaacataaagtaagcacagtcatatgccacatgttctcactaaactataaatttgtccctgaatagccttgcagccaaaggaaagagaaaagttacaagcagttgtacaatttttactgttttatgtggaaatataaagcaatttattgggaagaagaagtatctcttcaactcttaattcacttctgtttagacattgagagatacagtagataaaatcattgaaagacacagtagatactttcttaaataacatccctatagcaaataaaataatatgctggaaacgaccatgttaaaatttgttcttcaaggctgggcacagtggctcacgcctgtaatcccagcactttgggaggctgaggtgggcagatcacctgaggtcaggagttgaagaccagcctggccaatagagcgagattctgtctcaaaataaataaataaataaataaataaataaa

SEQ ID NO: 260442 - DNA, 508 bp, Homo sapiens
aggcagttctccgtgacatgcatcggctcagctctgtgattctaaacacgggctgggcctgtaggaatgtccgtgacaccccatcaccaagctcccagtgcccagccagccccattctgtagctggcagcatgtcacccatcagcagccaaatccctgtccctggcctatggcaggctcagaaaccctcaagacttgagatcctgagcctcctcactggaggctgctgcagaaagagttcatctctgtataggtacaggaggtttggggcacacctgggaaccccaccatcccctcatgctgtacattcaacacaaccgcttcctgcgctcccagcccagactcacaactgaattcaaatggaacctctgatgggtaagtggaagactcttccacatttcccagcttgtcttcacccacagggcagtgagcctaaaatgtatctaaactgtggccaaaagcaaaagaaaataaaaacaaaattgttcaaagcattttaaaattgcctc

SEQ ID NO: 260443 - DNA, 451 bp, Homo sapiens
gttagctcccaagctctctcaaccaccctagtgtgagaagtatggaagggaccaggcagccctgtccaccaccatattcccattcccataatggaacctagctggtagagatgctcaaatgatgtttactgaatggtggctccagggcctttccacctgctgatcttcctgcctggaggaagctcttcctgagatacctgcatggttccttcccactccaggttccctttagaaaggatgttcccaaccatccaacctggaaatagagccccactgccaccggtgctctgtgtctcctcaccttgcttgatatttctagagagcacttatcactacttgaaattatacaggatatctgcctgtttcctgcctgtttcctcctcagaatggaagctcctcttgtgttctcgtagaaggcgctcaataaaaatttactgaagcagtgaaagat

SEQ ID NO: 260444 - DNA, 502 bp, Homo sapiens
ttaggcacgagggcagactcagcaatacatgtaaaggctgccaaatgcaactgggacattgggcagaagccacttgggaggaagtgaagataagtacacatagggaccagagggctcagaatagcagatctcagaaagctccagcaaaaatatacttgttgaaggtttagggtggaccctaaattgttttgcaacagtttgacaactcactgtaactgggttgtgtagagatgggagaacaatatttcatggatggaattggtccagagaagcagatcaggcagactattcaacaattatgtaaaccaatagcatgtatccaaagtagtttgtctctgtggcagcaaaggagagagccattcaattgtgaggcctaattaatttgaaatgctaccctggtcttccttcacctcccatctttttataggagcttatacaagttaccaatcgaggaaaattcagctcattcaatgagtaattaaaaggtactgttaaaaaaaaa

SEQ ID NO: 260445 - DNA, 400 bp, Homo sapiens
gtcctcccaccttggcctgagcaccagaatgaaggggagagtaaggcagtggatctttgggaaaggagtgttccaggaagaacagagatgcttctggttattttaggaggtcatgaaactctcaaaaattgtcaaaacagttagtcttaatttatcataaccaaaaagaaattataccttaccttatggaaataataaaatttagcatcgtattttgataaaatgttacaactccaaaatgatcgggagtctgtggataagcccatgcctgtaccatggcaccagctgttatctggctaaatattttgtaatctatgttgtaaaacttcctcttctgaaacttcccctcaaagttgaacaaacacaaattagaacaacatgagagtgatttaagaaacat

SEQ ID NO: 260446 - DNA, 493 bp, Homo sapiens
cttagaaacattgatcattttttcttaagcatagtgcctacaattttgattggtaaatggggttttgggcttggttgtggaaagtgaaccaaccatctgtttttttccttggactgcagtggtgctcaacagaacattttgcacgaggagccttaagctaaacatttgctctaaaacatatatgtgtatctatacatctatgtacatgtaaaaaaaccatgtgtatccacttatcagaataaatctctgatgctgggtgtggtggctgatgcctgtaatcccatcactttggaaggccaaggcaagtggatcacttaatcccaggagttttgagactagcctgggcaacacagtgaaaccctgtctctacaaaaaatacacaaattatctgggtgtggtggtgcatgcctatagtcccagctactagggaggctgagatggaaggattgcttgagcctgggatgtcaaggctgcagtgagccatgagcatgcc

SEQ ID NO: 260447 - DNA, 1003 bp, Homo sapiens
atagcagtgtgagaatagactaatacacagtccatcagggtattgggaagactgtggtttgcaagaacacagcaacatcagtggatgccttttggatggtgatggccttgtgttaactgcctgcagctgatgaacgtggtggggaacatgctgcatttcctacctgcctttgtgtgcaggtgaagcaaccagtctcgaagcactacgcaggagtgatgatgatctgcgacacctgcatctactcaggcagcctgctgagccccagccatagctggatctgtgacgagctcacgggcagcaggggtctgacacaatggggacctacatcgtggacctgctgacccacccgaccttctggagagatgagaagttgcacacactgtcaagacatacatgaggcagagtgccaccatctgtggcatccagcatgtcaccattgatgacttctgtttcaaaaaaaaaaaaaaaaaactacctgccgaaacaggattcaacactgtgtaaaagaaggaaacaacttcacaacatcaagatactaagcaatgtagcagttacaactatacaataaaaaattactagacacatgaagattcaacaaaatatgatccataccagaagaaaaatcagtcaatagaatcagaaatgacagagatcatggaattagcacaaaaaaaaccattaaaacagctattactaatataattaagaatttacaagaaaatatgaacataagaaaaaatgaagatatgaaaaacaatgaaatgcagcttttagacttatgtaatgcaatatctgaaaaaaatttaaatcactgtaggagcttaaagcaaatttaatgtagaagaaaagattgatgaccttgaagacatagcaatagaagctattcaagctgtagcacacagagaaaaatacaccaaaaagccaaactgctatgagtgtctgcagaaataaacttcagtagatgtgtaactccaaggactgtaggtagtggaattgacagata

SEQ ID NO: 260448 - DNA, 136 bp, Homo sapiens
catacaatttacctatttaacaaatctgtaggtgtactcctgaatctaaaataaaagtttaaaaaaaacttggtcaaagaaaaggaggtattaggaaagcttcccagagaagtttatatttaatttgcatcataga

SEQ ID NO: 260449 - DNA, 260 bp, Homo sapiens
actcaagtgattctaatgtacaaccaaggttgagaaccattgagctagactaattactggtttaaaaacttctgtgctcttatgtagtgcaattagtttgcttctaatatttatgaattgcttttgaatttggagacaaaaatatcaggatcaaagtgtaaatattctttattttcagactgataagaggtaagaggaggtgattcatgtttatatgcctttaaagacctttagttttcacttgtcttataggttcattt

SEQ ID NO: 260450 - DNA, 933 bp, Homo sapiens
gcctgcctctttagtgactacagacctcacttcccttctctggagttttggagtctattttcttcatggaattttgctaggaacaaaagaaaagtctaactccattaaatgccttaatggataaagaaaaattggatgttaagattgaatattgtaactatgcaatggattcctcagtggaaaacatgtatgtaaacaaagtgtgggttcaatgtgagaatgaaaattgtttgaaatggagattgttatcaagtgaggattcagccaaggttgatcatgatgaaccatggtactgcttcatgaacactgattcaagatataataactgctcaatttctgaagaagacttccctgaagagtctcagcttcatcagtgtggatttaagattgtctattcacagctccctcttggaagcctggttttggtaaaattacagaattggccaagttggccaggaatactttgccctgaccgttttaaagggaaatatgtaacttatgacccggatggaaatgttgaagagtatcacatagaattcctgggcgatccccattcaagatcatggataaaggcaacattcgttggacattatagtatcacattaaagattatgagatctatgacttatatccacatgttgctacagacatataagaaataatttaaagtaatgatcaatatttgaaatcataccaatgaatttttgaagctctataaagaagattaggctaatcacataattcaggattaaaaaatgtagcagcctttcattttcatctccagtttcctgactgggttgtttttcatgccaccttgaacgaaatatatctatttatactactcaataaatatttactcaactcctattatttgaaattcttctaggttccaaagtgaacaaaatagaccaaattgaatgccctcataaaatt

SEQ ID NO: 260451 - DNA, 476 bp, Homo sapiens
gcccacagttgatgcatattcatcccatattaagagatagggaagagtgatatgatggacacaccagggctatggagtcagagacgtgggttttagtccgacttcctttgttactatgtaactttggcagttaaactttgggaacctcagtattctcatctgtggaggtaaagacaaacattacctgtgaagcgggggctatggtgatgataattagcaatattttaagtagagagtcttctacagtgtttgacacaaaatagatgtttaaacaaacagaaaaaacatcttagctgttatctgctatgcagttcaaggtaaagagtagatgagaaagccagcctgaacacagtggtagtcctggagaatggataaccaaagcaaaagcaaagcaaaacagttaccagacaacatggaggttggtaatggcagtgaaatccttgattgctagcagtggaaggagatatccaaataaa

SEQ ID NO: 260452 - DNA, 316 bp, Homo sapiens
ctaactagcccaacatgatattcccttggatgactgctataccagtgcttgttaagctccaaggtgtttggaatcaccggggcatcttgttgaaatgcagagtctgattaagtaggtctggggcggtgccttagattctgcacatctaacaagctccaagtaaggccaaaattgccacttgaagacccacatgctggatagcaaggtactgtataacatttaaccttctttcttctgtaacagggatcagcaaactgtggcctaccgattggccacctgctttgtgaataaagttttattagaacacaaccacatt

SEQ ID NO: 260453 - DNA, 491 bp, Homo sapiens
atatttataaacttaatctttggactaggcatcctaattgtaattccatatcttaaagaagcaattctaaatataggaaatgcttcacaaatatggttgatttttgcagagttacctataaaagcaaaaagttataaacactgtaaaaccaaccataggaaactgtgttaattaaggtacattcacttgatagactatcatacagcattaaaatgatatttataaagaacttataacaatatgggggcaaggtttatgccatattgttaagtaggaaaataactgaatacaaaatcaaatatgttacatcaccattcaaaggtataataatgacaataaaaagaatctcatcaacatggtcggaagaaatacaccaagatattaaaagtaattgttaattgaacaatggcatcgtaggtgactttttctctctacttttctgaaatatccaaattttttacaataaacatgtatgtatttacagtgaaaga

SEQ ID NO: 260454 - DNA, 1927 bp, Homo sapiens
  misc_feature (110)..(110): n is a, c, g, or t
  misc_feature (495)..(495): n is a, c, g, or t
  misc_feature (687)..(687): n is a, c, g, or t
  misc_feature (834)..(834): n is a, c, g, or t
  misc_feature (1002)..(1002): n is a, c, g, or t
  misc_feature (1007)..(1007): n is a, c, g, or t
  misc_feature (1103)..(1103): n is a, c, g, or t
  misc_feature (1129)..(1129): n is a, c, g, or t
  misc_feature (1326)..(1327): n is a, c, g, or t
  misc_feature (1892)..(1892): n is a, c, g, or t
tctgtgtctcagctcacagggcttccaggatcatggcctataaaatgcttcaagtagtcctgtgctcaacattgcttatcggagcattgggagcgccatttttgttggangaccctgcaaaccagttcctacgtctcaaaagacatgtaaatttgcaggattactgggacccagatcacagttcagatgtgtgggtaaacacactggctaagcaggtatttgtattagaaacaaatggtccttcaccatttatctttttaaatagtcattgcattagctgaccactaattaacacatgactagcctagccctgatttttcctctctagacactctgaactatatctgctttttcttgcccatgaagtggtttttgcctggtaaactctgcctcttgcttaaagactagactcaaatgtccctctgaagcctttcccttcttctcagggcgacatttgtctttccttctctccctttttgcatgctctttcacaantaaatagctctcaaaatgtcaattggaattacttgttttgtgtacccaacctacctacctagactataaaggtagggtctgtatcttatccttcaaggtaattattctcgggaactagcaaaatgattgttatatagtcaaagcttaataaattattacatgtatgtgtagattgatgaatggatagtggtnggactttagttcactttcagttgttcagtagctaaatatccccggtgacaattattcaaggctttaatgttgttcctccttttgcttgccttttgtacattttcctattcatttgcattctcgctgcaaaagaaacaaagaagaaanttgcattggccttttttattctatatttacttttctgatagaagaagacattaaaactccaggccaaatgaaattgctgaattatctgagtatttcaattattcatgatctccctcttacaatttagcaatttaggaaacaaagttgtataatgaatgaatgaattcnttcanttattctttctttccacatatctcaggatctgattatcatcaggcatgaggattgtataaagtcataaaaagttgaatgtccttgttttcatgggnccttgatcttgtccgtactccacatnactgggtcttaaccggtctaccaggatctgcttgttttgcacttgctgatgaaaactactaactgaataatgcatccagttttatggctgtttttgtccaataggcattatttagcattattaaaacaagacatttgtttatttggtcaattaagtgattaagtaggctggtagactgtgtcttctttatagaatgnngacattttcaggtactctcctgcctctacttgtagaccagatttgtaccaactgacaggcactatgtaatgtagcaagactctgctacattggtttatactgtggccccacaaatactgtaaaatatctgagtattgaaataaacagataattaaaagtatgaaaaccaaattctatttggtataattcttccattatatttttctcatcttttaggaatatctgtatgataatcagaataactgatgcaagatgtgttctacacactcagagatcatgacttgtgtttccttttcttgaaggctcgtgaaacatggattgctttgaaaacaacagcacagtattatttggatatgaataccttcacctttgacatgtctactgcccagtaaatatgttttcctggttaaagcaggaggatgaagatggcagaggttggaatggcattgtgccaaaaccatgggttttagagatctgagggtatatccatgctgtttactacattatttattatgtctgtctcaaagttgttgaaaacagtagttatgaaaacccatgtaggaanctggaataagacattctcaataaatggtagttctc

SEQ ID NO: 260455 - DNA, 1019 bp, Homo sapiens
  misc_feature (344)..(344): n is a, c, g, or t
tctgtgtctcagctcacagggcttccaggatcatggcctataaaatgcttcaagtagtcctgtgctcaacattgcttatcggctcgtgaaacatggattgctttgaaaacaacagcacagtattatttggatatgaataccttcacctttgacatgtctactgcccagtaaatatgttttcctggttaaagcaggaggatgaagatggcagaggttggaatggcattgtgccaaaaccatgggttttagagatctgagggtatatccatgctgtttactacattatttattatgtctgtctcaaagttgttgaaaacagtagttatgaaaacccatgtaggaanctggaataagacattctcaataaatggtagttctcaaaaaaagaactaaaaaaaaaaaaggctgtagtaataacatttaccaaaacgatggcatttatgggaaaaggaaagcaaaaacataaacaaagaaaagtagtttcattaaaccactctgttcatagcttttactctctattgcctcttctttgagagagttttttaattcaaagaaggacagggagctctcaaatggagctgatcctcttctctcttcttcagtgcttgtcgcattcttaagtcagtcgattttaaaaccatgactttgaaacgtttttcatcaaaggtgtactgctgagtggagaatacagccttaccttaatacaacaagtagatagtggctaggaactcaatggaagtcattcacttgtaagtgcaaacttcttccaagttttgtaaaatttttgtaagctttgcattctgttccacaatttattgatgtttgttttaatgtgaaataacagttttgactcactggccaggcacattttataattttttcaattaaaactgaaaaattggccatagggaaaagtggactgcatttatcctataactttcctaatattcatggattaccacctcagtttgagaagcattgagatgatacaactaattgccaagattgccccccaaaat

SEQ ID NO: 260456 - DNA, 220 bp, Homo sapiens
cacctttaacatataccttaaaatcaatacatagtccaaagactcaaaatttcttttccctggtaggagtgtgaccgaaaatacagttatgaccttatacttctcctctccaaaaataaacttgactcaagataggtaggtactatctcagtttaaaagcttattatctttcaaacacaagaagaatgccagggaaatacatacacacacacacacacac

SEQ ID NO: 260457 - DNA, 405 bp, Homo sapiens
tcatagagatggggtcttgttatgttggtctggtctcaaactctttatacccaagtgattctctcacctcagtccccctaaatgctgggattacaggagtgagccaccacacccagcctcctccttcctcataatagcctttttttttttttttttttttgagatgaactctcactctgttgcccagactggagtgcagtggtgagatctcggctcactgcaacctccacctcccgggttcaagcgattcttgcacctcagcttcccaagtagcaggattacaggtgcctaccaccacactcagctaatttttgtatttttagtagaaacagggtttcaccatgttggccaggctggtctcaaactcctgcctcaagtgatcctcccacctcggcctcccagagt

SEQ ID NO: 260458 - DNA, 414 bp, Homo sapiens
aaaggagttcttaattttcctcattcaaactcagccttcagcctccaaagaatcacaagcttggttcttgagtgtaggcctttttcattgttctctgccctttttcctatggcagctttattctggcttgtgtctttggcacatcttgtgagggagtttccttctgactctcaggggtaggagacctttaaaagtacaagggtagtatactgggcccagaaatgtttcctgtcactcctgtaggagtagaggatttttttttcctcttatgtttttttctcttcacagtgagattactctgttccctgtgtggcagcagggtttacagcctttcttttaatgacattatggctttcattccttaaaggagaagggtctgggtgagactttgggtctttcccactgtggtggccg

SEQ ID NO: 260459 - DNA, 305 bp, Homo sapiens
aaaacacagcgactatgcaccaatcagtgctgttcatagagattcatcttctgctttcaacactggagccagatcttgcaggctgttttgcctccctggtgaagtgcagttcagcagtttagcagacagtgagcatcacaagaccaggcatcagaaactgggggaacaacaagacgttggggaccaagtgcaggagagaagaggcttcagggtgatggaaccgcttataagaagccgcagcagtgggagggctgggtgcaaggatgcaggttactaaaaggggccatggcagcagccccttgtga

SEQ ID NO: 260460 - DNA, 354 bp, Homo sapiens
attttttatatttcattaaggtatacagaaattcacttgttttaggcatttttaccaatctagcatttgaaattcatcattaacactatacccaaacttttcactgaaataaaattataattgcggcaagttccactcaacaattacttagtcttttaatttcttactttctgtaagcaagtttccccaaccaacaatcaatcaagactccacgctaaaaacaacaaacaacataaaatccaacctgtcttccttcatctcaatcacccttaatactcactcactctccctttcctgtaaaaggaaacaaaaaagaaacaaaaataaaacaactattctttttaaaacagagga

SEQ ID NO: 260461 - DNA, 788 bp, Homo sapiens
cccggccgccgcaggagcggctccccgccttagcccgcaggccgcgaggtgcacggccctctctaccgagaagcctgaccgccccaggcctccccgtcggcctccagcgcctacacccgtttcggcgcccactcttcgttctgcgcccctagatgcccatcggctgcgggagaggctcccggaaagctcggtggggccccgcgcagagcccgcccgccggagccgcaatgctgccatggtttccccgcgccaccagccagcgacattcacgagagagacgaataggacacggtcatccgagtgccgaggcgcggaagcgcgaactgcccggagcgacctggcttggcgcacagactcattaaccaagcccgagaggaggcagcaatgcgtgtgcgggaaagggagcggttctcaaaatacaaagtgataaaacagcttccagttatattgaaaaacgatgcaaaccctcaattccttttttttttttttggacctggccggacctggaaatgccggttataaacaagaataaaaacttgaatttattggtggaagtcctgttaaaagagctcaacacaagcatatgagacaaactgcaaaaagcaaacagtttccattcaaaaagcagggcccccctttgggtttttgtttaagcgtttgatgtgcccatgagacccctaacaaagcctgaaactaaatttatttttccctacatctctctgggatcaaacttttggaagtaaagcatgtatttatcaataaaacaaatgtttgcccagcatcatcca

SEQ ID NO: 260462 - DNA, 1058 bp, Homo sapiens
gtaattttcttaattgaaaaaatggaatttaaagtcaggaagatctaggctcaaagttaagctcaagttcactcagttttcctaagtctattttttcatctatataagatggtggaaacattgcctaaatgtagagtttttatgataatatagataatataggcagcatagtttctggcaaagtgtgagtgcttataacatgtatgacacccatcagggtgatatttaaaaatatttaaccagtgaggcatatgcatgacaggttaaaagaaacaccagccacaaacagatggtgtggaggtaccaaggcacaatgactaaatatcatgtgttatttccacagtttatacatcacctgattttgaaaggaagatgtcttacccaggataacttagatctcgaagtctccttatctcattattgaatatgaacctacacaaactttttaccttgtgatttgtatccacatccaaattactctgttagaatctgattaaattatttttgtttttcttgggatctgacttttgggaggctttaagtgattatgattgcacttccctccacctggaaaccacctcttccttctctgatctcaccttggcttagctctccaacacaagactctgtggtgtctgcccatgcccactactctcactgttgagaatagtattcaatatctgtttaacatatataactacttttaacaaacactgaatactcctttttactaaaggtgtaaagactgtcaagctttggattttctctgttaataatcaaagtttatagaaattttaatacttacctagatattctgcaaggtgatcaaattctggtttattggcaatgagctcttcttttgtaggaatgtttattcccatgaagcatggatatttaattggtggtgaagctactcgaatgtgtaccttggaaagaaatcattgcacacaaggtttttaagactatgcaaaattctttcattgtgcaaatacaatacaaaattgttttgcagaatattcagtaacaacatatgggtaataaattattctttctacaaa

SEQ ID NO: 260463 - DNA, 602 bp, Homo sapiens
tttccttttaggaaacaacaattagtgacatccttgaatccgaagtagtgaatgaaatattgcctttatcaaactccagtttttcaggaaaaggtttggtagagtcatttgcaagtcttcaagagactgaagagatcaagtcaaaagaagcaatggcaagttcaaagtcccctgaaaagtctcctgagaatcttgtgtgttcacagaattctgaggctggatacataaatgtggcttctctgaaggagacacatggtatacaagaacaagaccaaaagtcagaactataaaatcactggtgcctaaagctatactgaacaaaagtggtaatttaaagcctggacaaaaggtggaccatgacattgagaagagttaccacagatcccaaatggatatcacccaagagtcttcaaaactgctgataaattcattaaagcagttgtaaaaatggatttctcaagtttgtttgatatcctcagatgccttgtattgaccaaaatattgactttagttcaatgatttatttaggtttctcttcagcagagcacatgtagggttaattcaacattctttcccattatcatgggtatcttttctgattt

SEQ ID NO: 260464 - DNA, 263 bp, Homo sapiens
taaggtcccgatggagaaccatagcaagcgtcccctccctgtttctaaagatgagacactgtgactgcatttgttttttcctctttgttcaaagctcagtagtaatagtaatagcaacagttgccatttagtgctaaagttgctagagtgctagagttagcgtttgaactccgcctgcctggcttcagggtctgtgtacttcatggccaggctctgcttcctctgggattaaataatctttggcaaaatatgtcaccaccatg

SEQ ID NO: 260465 - DNA, 666 bp, Homo sapiens
gtaagtagcaggttgttgtatgtacgttcttactgataacccactggtcaatgtttttgcgttggtcttatattttggtaatttcaaaaatactcagtaatatgttgttattaatgcacagaagggatatgtgtgtctaaatgcttatatttgcttgctttgtcttaggtttggtgtgtctttttaaacttgggaatctagttgttatcttagcagtgtaatcaaaacaaatattataacctcaggactaattcttaatgaactttgctgaaattgaaagttgttgctgacaacttaagagcatttcttctcatcctcatcagccattgtgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagattgtacaacacttttctgtgttcatgaagaaaaaaatata

SEQ ID NO: 260466 - DNA, 346 bp, Homo sapiens
tgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaggacgtgtttgttttgacgctgtgcctctacccttggacagagtggc

SEQ ID NO: 260467 - DNA, 463 bp, Homo sapiens
gcatcttattaactcaaattgaggcttggagtatgagggaccagcaggaggaacagacctcacccaaatccctttatgaatgaggctgcttttaagtgaatttaagtagttggaaaaattattgttgatctcaggcatttactgaccgctctcagtcgcttctgcatctcatcgttcaacactcaggatgcgcacatccatagccagtagcccagaacttcatttagaagttcaaccctggttcttcccaccattccctcccctagacttgagaccttgcctcaaagccccaggattgtttaagatcatggatttataagttgttcaatatcttggaagcaggcatggttaaggcttctgaaatgtatcttgtgaatcattcaaagaagaccttagtcctcttgagtcacatcttcctcacaccctgcagacagcaagtggccattaacgagtcactagtttg

SEQ ID NO: 260468 - DNA, 391 bp, Homo sapiens
aagttgtgttcgtttatgattctttaaatgttttccaatacttagatacatcaaaattataggacttctcaattccatcctattgttacagaatataaatttaatcaagataggaagaccctcaaaagatctttctcatgagttcagatattccaaataataattacagaatttcatttgtacatttgaactcttatcattgaatttgtttaattccttagtgtcttcctgttttcaggcttacttttcaattaatttcagtctgcaaaaagcttcaaaaatagatggtagcttttatatggttcctaatgttgagtgatttgattaaagttttccaactgattttgaacaaaatgtaatgaaagcttagaagactagtttacaaaaaaaa

SEQ ID NO: 260469 - DNA, 517 bp, Homo sapiens
cagcttcggagcaagggctgcaaaccagaccctctccagcactgagtagcacccgtaatccctccctttgggacaggggctgtggaaagtagaaggaggtgatacaaggaaagtgctggagtcccaagcagctggggcatgaggtccttcagggggcagcccaccaggacccccaaatccacgcatacctacagctgggagagaggccagccaccaacccacatcctcggagagtgctgggctccacttaggacacaggactgtctgcccagacaaacgggagacaggctaggactgcttcctcagcagtgcagaggaggggttcccagggcagctggctctgggcctagaagattccaaagcctatggtagttcctgatggagtcgtctgtcctccatccagggcattaagaactaggaatgaaggggaatcggggagaataaaaacacaggaccacagcccagcggcctgggcacagtctagctctgcagagaccatggggctgggctgtccact

SEQ ID NO: 260470 - DNA, 430 bp, Homo sapiens
taacctccttagaacctaattaggcttcccaacctgcaatctaacgagcttggtgatgtggctgccaagtttacagcagattcaaaggctgatggaaatgtttggggatgagacagaggcgatgatggaacaacactgtgaagagaaccacagcacggctccccataaaagtcatctttatggacagatatttcatggcggcagcttgagaaggctcacgtttcttaggcagctggtgcagagccaggagagctaatcatgagatcttccagtcccaggacgtgggctgcagctggcggctgtggtcgtcttatatcaaactctcaagagtcacagggcagcagcattggccccctcccaagtcattccagatgggatttaaggtggcttaatgagcattcataaaatacagcaagagaacataaactga

SEQ ID NO: 260471 - DNA, 703 bp, Homo sapiens
cattcactgtttacatctttgcactgctatatatttgtacatgcttctttctcttcctgaaatgaaactctgcattctcctctctacgtccttatttaggtcccaccattcttcaaaatccaactcgaattgaactccataaaaaatccacttccctttcttccctctgcccttgtcctatctccaccacttgttaacctcacccctatttaattttcagagcacatctccaggcattctctcttctgatgtagatatttacatacatttgtcgtttccctgcatgaatgccaaattctttggcttcaagcttttttcttgattcatttgtgtggccatcataaagtttagcctatgccttcaatataccgcgttttgaagaacatgtgttcaattataatgaatagaagaattattgttaaagggggcaatttaggttggattgaggacacccagcatgaaactgaaatgactgagaacaggcaattcatgactgcatgctctaaccactagactattttccattctgaataggacaatagtggtcattattttgttgccacagtttcattctcacactcacactgagcctttgaagtgaaatctctcctagcaccactgaggttgggaggattgctcactatttggagggattgcagtagaaagttatgaactctctggtgaaatgctgctcagtttattc

SEQ ID NO: 260472 - DNA, 395 bp, Homo sapiens
tggcctcccaaagtgctgggattacaggcgtgagtcaccgcgcccagccacatttccaactatctgatagccaactgcttcacacatctgtgtaatctgtctggcccctgaatgcatttctgtttgggatttctggatctctagattctaaaggcatagataggtgcattgatgcattccacaaatattgaatgagtgtctctcataggccagtcactattgctgacaatgggaacacagcggagaacagacaaaaatcactgcctttgtggagttgagattgtgtaggggagagacagataagctttaaaaaaaaaatgctgaggctggaggatcacttgaggctgggagttcgagactagcctgaacaacatagtgagacacccctctctaca

SEQ ID NO: 260473 - DNA, 557 bp, Homo sapiens
ctaacttcattattactacatcataataataatgaaatttattattattgcatattaaatgttttatttgcagtattgtgatgaacatttacttgcaagagatttgtcataagaaaaccttaaaacttttatgtaaccattttttatcttgtacaaggataagttttgaggtaaattaaagatggaaaacagtggaaataaaaagttatctagtgtctaagtttagttcaaagccatgcttactatcttttctggtttctatgatgacatggttgttgaaacatgcttctgatctttgggtaatgtattactgttaacataaaccattgtgatgacataggaagcaccaaaacctatcttcaacatttgaaaaaatcaggagccgtgtataagtcacaaaatgaccttttcttcgtttctgggttgttagtgcagcatgctgagaaaaacaggctctgcaaggcaacattaactgacagagttgtgggtcaaatctctttattttaaaagaggggttactttggagccaaagttaagtgttcttagggtttgggcag

SEQ ID NO: 260474 - DNA, 619 bp, Homo sapiens
gcacagaagacaggaagatgtctcaactgtattctaaatcctaattccattcctaaattttctccagatacatcttgctaatggcttctatttcatcaaagttaaaacatcatgcccacaatcacaaacaacaaaaaactaaaggcagacagacccatcttgaatagtcgaataaaaatacctaaggagaaataaactccccaggagttatatactatgggatgttcctttacactaataaaatcatcttccttttaaagtcaacatttgaatttcgcagttatccccttacctggaaaatgatcagcaaagcctgagaggtgaaacattttactcctgattatacatatcctctacagatgctaaatacccatgctgaatttgaaatctgagctgggtaaataggaaagaatgcatgtcccctttctttctttctttctttctttctttcttgttcatagttgaaaaggctgctgagttttgtttgtatgtttcttttgtgcctgggaaatgttttgcaattcttaggtatttgaaaaataactaatattacaaaaaaattaataacttaggtagcatgaaatatacactcacactaaaggaaaaataaaaaaacaaa

SEQ ID NO: 260475 - DNA, 545 bp, Homo sapiens
  misc_feature (2)..(2): n is a, c, g, or t
  misc_feature (13)..(13): n is a, c, g, or t
  misc_feature (54)..(55): n is a, c, g, or t
  misc_feature (99)..(99): n is a, c, g, or t
  misc_feature (119)..(119): n is a, c, g, or t
  misc_feature (152)..(152): n is a, c, g, or t
cngaagccccccncaggatacgtgtacagggtcccagcccccatggtgattccnncaaagaaaggggcccttttgtcgtcttctgcaccgtagtcgacncggccgcgaattcgcggctncgtcgactacggctgcgagaagacgacagaggngcctgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcccagtggaagcgaagagatactcggcaagtggctgctggtaatgggacgcaaatgttgacttgatttgtgggacatccacgctgagaactgagtgctcacgtaactcaaatgggggtaatttggtttgttccactatatgtttatcttcaataaaatacctactgtctgtac

SEQ ID NO: 260476 - DNA, 347 bp, Homo sapiens
ccactgccacaatagaggacaacaagatttcctttgcactgcctagtaaatttcctttttcctactccaaccatccgcaaggcttaaaaacttcaaactcagaaaaaaattggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcc

SEQ ID NO: 260477 - DNA, 476 bp, Homo sapiens
aggcctggccatctgaaacaggtgtgccttgtgtgggcgctgctggctgcagtggcctgtgttctcctgccgtttctcatggatgaaattgcaaataagcaagcgtgaggtttgtattacattcaatttgttttctaatttattgtttgtgctgttacaagttgtttttaaagcaagcgtttgggcagaatggagtctctggtgctctgtgtgcttttgaaacacatgggcggcatggcgtgtgtgcatctgcgttgggcgagttgcttagcctgtcttgtagcactttcccgatggtgtgtgtagtttttctttattactgcatattatttcacagtagggacagatatgtttttatctagctactgtcctgttgatggagatgatgttttctttgtagtttttaatcttatgaacagtattaaaatgaacatccttttatgtgtctccctgcacgtatttatgagtttctctaa

SEQ ID NO: 260478 - DNA, 621 bp, Homo sapiens
cacaatttaactttgctcaggctgatggagtaagaagaaaagatggaaagcatcatcaagagaccaagaaaaagctgtgggaaattacaaagagcagaaaaagcctagatcaatttccatctaaaagtctgttttcaaaagacacttggtttagcaaaaattctttttataaccatagtactaaacttttctttggccttcaccattttgtgacttggaaaacatttaaaatgcattaatggggtttgctagtggtttatgggagcccaataaataacatgctttttttctggactaagttctgaacaaacttaaaaatataagaacgaataaaagtagcagaaagattaaaatgttaccaggttaatttttttaaaaagttctcacaggttaaaaaaaaaaaaaattttacaccattttgatatttcagtgaatattcatattaatgaactaggttttgcaaccaaccagtcagtattagacactcccttccgaaagtcagccagtcaggaaagcaccctctacaaatatacatctgtgagtgtcaacctatccacaacagtctcacctgagtaacccctcctaaaaatggcatcaaacctataagcttttcaaaatcca

SEQ ID NO: 260479 - DNA, 292 bp, Homo sapiens
agtttataatgttttttaaatctgtggtttagtggttttggggtgtgtgtgtgcacgtgtgcgtgtacgtgtgtgcacatgtgcatttggggaaattcctagctattatctattcaaattatgcatctgcctcattctccttctctgtttcttttagggataaccttattacccagttctgttggcctgttttctaatggttatttttcttgaattttgctgatgtcctatctcctcatatggtgatttttatatcacttgccagacaatatatattaaaattttagaggta

SEQ ID NO: 260480 - DNA, 656 bp, Homo sapiens
caaaacagtttaagtcctaagttttgtgtttttttttcaatttcccccactcggccactccaagttctaaccttttaaactctgtattttctttctttagaagttatcctacaaaaataatcatgcaaaatttgaaagaaacaaatgcataaatgattcttacagccttgtatttagtggcaacaataccgaatgttcatcagtatgagaatggattaaataaattataaaacatccatacatttaacatcaatgaaacagaattaagtagactcattgattctaacacagaaacatgtccaacatatggtagaagtaaatcaaagagcttaagtagatgtactttcatgtcagcagaactgagttcttttgcagactctgcttcctactgcatgatggtgagaaaagtacttaacctatctaaacctacatctcattttcttcatttttaaaattgttttttaataagatgtcacatgcaaagcacttaccacataattaatagtcaacataaattagctgttcttttgttgttatattttaagttaaagtgttaagtacgagaacactgtgattcactgaatgtatttggagtatgtcatagcatcttacaatgtagttcagatagtattgaagttaaaagatgaccttgtttt

SEQ ID NO: 260481 - DNA, 667 bp, Homo sapiens
aactgatcctgttttaagtttattataaaaaaagttaaagaataaattatagctctatatgcaaaatcaaaattgcttgccataaaagaaggcaaaggtaaaacaaataccaaaatttatctgaaatgttgttacattttttgaatttaataattatataaaattttttatgaaaaacaataaaataagtctagtttattgacataaaaaggaatatctgaaatttagcttcttcagtgagattaaaactatgatcagtcaataataaaagacaccatttggttggatttcccttagttgaaggagaaaattaagttctaggccagagagatgatatgattgaacttttcgtttcactattagcaaggtcagagaaattctactaacatgttgtataaaactggaaagggcataaaggcttagttgagaatattcaggcaaaatgttgtatggggcttttgttcaatgaaatgtggtttcaggaagtaacggtaaatgtgttccaggaaccaatgaaccaggaaccagaaaaataaattgcagttattggttcagttaatgggcgtgggtcacccacccaaccttcctctttgcttcactcccacccccacccgcgagtctcagctacctccacttaaaatcagcagtgtatgccaacagtctagaa

SEQ ID NO: 260482 - DNA, 96 bp, Homo sapiens
gcattcctcccactttggcctcccagagtgctggtattgcaggcaagagccaacatacctgctggaaagtttttctttatagaacttttgtaccta

SEQ ID NO: 260483 - DNA, 542 bp, Homo sapiens
catcaaagttgcggagcatgtgtacatactgtctataagacacttgctttatattcaaagacacaaatatggccaatagtgaaagaatggaaaaagatatttcatacaataaaaattgttataaaacagagaaagacattatagttgtataaagcatcaatttatggagaaaatgtaacgattataaacatatatgtgcctaataagaactccaaaatgtatgaagtaaaaactggcataattgaaggaagatatagagtgttctataataatcgtttgagacttcaatactccactttcaataatggatataacaacatattagaagatcaaaaaggaaacagaaggattaaacaataaactaactagacctaacaaatatataaagaacacaccacccaacaagagaatccatattcatctcaaatgcacatggaacattctccaggatagattatatgttaggctataaaaaaagtctgactaaattaaaaaacaatgaactcatacaaagtatcttccttaaccacaatggaatgaaa

SEQ ID NO: 260484 - DNA, 571 bp, Homo sapiens
gactatgtgaactaaaacatgataagaagctgtcattttaacccccacagtgacagtttccccacaactgaattctaatcttaagtgatgcactccccagaatgttctggacaaggcctggtgccatccctgctgcagtccctggagggagagcagggggtctcctcggggccaccgtggagtctctggggcaagagggaggctgccggggggaggatgacaggtctgctcacttgtggactggacacaattccttctaggctgccgggggaggatgacaggtctgctcacttgtggactggacacaattccttctaggctgccggggggaggatgacaggtctgctcacttgtggactggacacaattccttctaggctgccggggggaggatgacaggtctgctcacttgtggactggacacaattccttctaggctgccctctggatgtgaattccagatgcacaggtaatgtagcagcagaaattcctctgagattatgtctgtgtatagttgtgttggtttgaaaagtgttttggtcatttgagtcttcatacttagtaaacaaac

SEQ ID NO: 260485 - DNA, 513 bp, Homo sapiens
cctgggccccatccctccccactggaggagctacaaccaggacaagcacatgggaagggaagggtgggttctttctccagggaattgcttttctgtccacttagtcacggcaggaaccaagaacagagagaaggaaagaagctaaacatggggcaaagagcaatgtgttgggcagggcggggaggcagcacgtggggttaagaggattcctgcctttcagcctcgaacgaaggagaaagaaatcaatatagtttgctttgtagggatcttaaccaatttcctgtaaagttttccaaaatgtctctttcacaaaagactagtaatgatgtggcaactctaggtcacacggaaaccctccgaatctcttctacattagccatctctgttaccaccaaccctccccacatatccttcaaaaataacagcacctggacaattgtctggaaacgagaaactcctttactcatagttctaactcaaaatgcagatggactctcttcaaggtttccgtaa

SEQ ID NO: 260486 - DNA, 492 bp, Homo sapiens
gatcatgtccttcttccctaatgtttaatttctctttgggggactttgaggacattctgtcatttgtcctccatcagaactaacacaatccattaaagaggtgcagtaatattggacctcaaaagaaaagcacttgctatttcaatttctactctcccaggatgtgtctcttctatataaattactcacctcagtgatcagctctgcaataccaaggggtcatgggagagattgttcttgtaacgccacatttcctccaaagaaattggtagctattggcttttctttgtgtaacctttactccgaacataagttaatgacctacctcttaaaagaaattaggcgtgttcacttttaacctttgtataaatagaaaaaaatagggaaagagaaaagtggataagtcattactgtacaactaattttcacaaagtgaacacactttgtaatcagcactgaaataaagatatagaacatgatcactggcaaaaa

SEQ ID NO: 260487 - DNA, 691 bp, Homo sapiens
ggcacacagtggacgccactgtgagtctcctctccttctgcacggggttggggagtttgctgccattttcacagtgaggaaaggggcgcccagggtgttgactttcagaataagcctgttctcttgtggggagagtatcggggtggtgggctgggttttgcagatgcttttccagggacttgaaagggccatgcaccctcatctgtggggcagggcctggaggggcggctgatgaatggtctccacattcttcccatggccctgccccggcacacccttccagtccctcctatggtgacccctgaacagagaagatggagtctgcaccaggagccctgaggcaggctccagcttctggccaagctccctaatgatgctgcggtcactcccatggggcagagagaggcctggccacacagggcctgacccctctcccagggccatctccacatgggggcgatgcagctgctcccaccctcctctgagcgctcaaggcctcctggggcaacagccttggaggtgacttcggagcagtggggagagggcaagcagggagcaggcagaggatttgctgagcagcaggagcagcggccctgcagatgcctggtgtggtggcccgggggagccagccacttcctgaggccactgctattttctgacctgaggaaaacaatgtgcggatttcctaagg

SEQ ID NO: 260488 - DNA, 324 bp, Homo sapiens
tccaattaactccacaggtgattaattttgaccagcggaagagaagagacaaaataacagattctctttccttcttccttcccatattattcagtcatggtttccctatatagcctgaatgcttggagatgtcccacaagactaagcaagtttacctgcaaagcaaccagctgcattctttgcagtttatcataatgaaatggccaatgtagacataaggtgtcaccttacattggttcatatcctttgttgcctctcttactgttttttcctcactctgcctgttctgaaattaactcttctaattaaagtattagcattaaa

SEQ ID NO: 260489 - DNA, 550 bp, Homo sapiens
agactgtagtaaatatcaccgcacctctgttttatgtgtataactggttattttcttaggatgaatttgctgggattacaggcatgagccactgcgcctggccaccaggtctagttattaagagttttaatgactatagccttgtgctttttatctcccttcaggctttaggctaaatagacttgattttattacctttattaattttgtataatattttttcttttaaaaaacaagcaggccacgtgtggtgtctcaggcttatcctcccagcactttgggaggccgaggcgggcagatcattgagcccatgagtttgagacgaccagcctgggcaacttgatgaaacccagtccctattcaaacaacaaaaataaccacacacacaaaaagcaagcaattatttaatagtggctatacctggtggggagctaagattatggatgattttaattttcttctttttgtatatctatcttctaaatgttccataataaacatatattagctttatataatagaaagaaaaaataaacttttagcaattaaa

SEQ ID NO: 260490 - DNA, 613 bp, Homo sapiens
tacatttcatagggctatccctacaagatagttgctgattatttttagcttgttttcaagaaagtggccaaaattagcatagtagttgtaaaaaaaatagttttattttttatgtattgaatgacatattaggttactattactaggaattaatttatataattaatattcaatatttgtcacacagatgtatgaaagacaatcataagcaaatgtatactttttcaaatatgcattagatgtaaatttaaccactctaatataaaaattctgttggatatttttctactgggacttccgaataggccaagcgagtggaggcattctaatacacaaatttgatgaagtttgaactcacaaaaccactccattatttttttgtttctgcaattatgtaagactctcagaaaagtctttagatctgacatgagaacttaactagactacatgaaattgtttctctttgcagctcattataaaaaaaagtagcatagatcttacattttagaaaggaaaacaagtaatagctgcaaatcccttcctaaaatggaattgctttgtttgaaaagaattcattctcacaatttgcatatgttttcttcacttataagtt

SEQ ID NO: 260491 - DNA, 418 bp, Homo sapiens
agggcacgaggctgagggttatggaacattcccaggaagggagagaatatcagaaaatgcaagactgccccagtgcagcagcagtgatgcagccagaggttaccagaagttctggcacctccaccttcatggacacaagctgtatatatcagtttaccatggttttcagtgtaaaaaagcaacttatgtccttcagtgtcagtttattgagctcttcagtgcagcctcataacttatattaattgggaggaaaatgcttccagagaaaggagagatgctggacaaaacaactttgtctttgactagttgtcaaggccctgctgtttggagtcattgacaagtccttgattcttgtatgacagatccaggggaaaaaaagaagtgattcatcttcttctgttgcacctttcaaggagga

SEQ ID NO: 260492 - DNA, 417 bp, Homo sapiens
agggcacgaggctgagggttatggaacattcccaggaagggagagaatatcagaaaatgcaagactgccccagtgcagcagcagtgatgcagccagaggttaccagaagttctggcacctccaccttcatgcctccccgtggcccccacctcctcaggatggccttgccagtacaggaggtttggatgtcaatctgtgtcgggggtgaatcaggatccgaatggcgtcgccccatttatacatgggtaggtatttgaagggaaagtcccccctgatgtagatttcatctgcttcgtccttagggaagggtggaatacgatgagatattacagcccaagccgtgcgccccctcctgcatggccgttggggagaatttgcatctctaatttgtgattaaacgtagcacctgtgaaaaaa

SEQ ID NO: 260493 - DNA, 295 bp, Homo sapiens
ccgagacaagagcccagtcgcattcctgattctcagtcccacctggctgagatgggaatggctgtatgggttgtctgaattcgggctttccctgagccaagcgcacacctcccttccctgctcacagcagctgttttcagagactgaggatgtttaaagctgccagaaaagcacggttacgttggccattccttttctgggtgttttctgtcatggaatgtttttccctgaactgtgacgattacagtgatcatttccaaatagcatttaggaaaaatacacagtacccacatga

SEQ ID NO: 260494 - DNA, 392 bp, Homo sapiens
tgcctgctgtcgctagatccaggttcaacagcataggtttttcagcagacaatcacaaccatgaaaacgcccaaaatggctccatgaatggaacgataaaaagaccaaagagatggacactagcacaaaaacttacgagccaaaagggacagtggcctgccgagccctgggcacaattattgagaattgctattggtccacgtgtctccatccccccggcctccaccctagacctggccacctcttctctcccctggattccctgaagcaccctcagtctggccttcccactcctgttgcccactctccatgccatagccaaagcgatcttttataaaggcaagattgtgccactgcattccaacctgagcgacagcaagacccagcctcta

SEQ ID NO: 260495 - DNA, 286 bp, Homo sapiens
ctcaggcgaccgtggtcttcgctctcctgtcaagggcatcacttaggggaaggaacgaacggccctttcttgctttctctctctgggaccagagagctggagagccattcggagcacccacgttatttttcttcttattaagaagacgggcggggagaggggaggacgcagaccctcgttcctcggggacagagccccgcccggcgccgcggcagagcggctgctggacccgggtgggccccggcggctcggggcgggggaggcgcgccccgcccagcgcggccgc

SEQ ID NO: 260496 - DNA, 495 bp, Homo sapiens
caatatatgagttcctgttgctgcagaagcttgccagtacttgctgttgttggacttcaaaatttttgctgttctgatgatgtttaatggtttcccattgtaactttaacttgaattttcctaattactgatgaggttgagcacctttttataggtttattgactatttggatttcctgtttttgtgaaggtcctgttcacaattttttgccattgtctattgagcttgaacagcttttttttggcctattgaccagctgcatcaactttttttgttaatttatatcttttttgcctatttttctaatgtaatctttatcttctaaaattcacactacaagtaaatgtttttaatacatttatagttttgtcttttactgtaaagtctttaatccatgtggactttgcttttgtgtatggatttttttttttttagatggagtttccctgcactccagcctgggcaacacagcgagactgtctcaaaaaaaaaaa

SEQ ID NO: 260497 - DNA, 288 bp, Homo sapiens
attccggtcaggtgctttagcagctcagttttcagggtttaagctgtctttggcttgaaggtcacatttcaccagggacccacccctatctgcctaggaatttgtctgcttcctgctgttattatttgaaagatacaggctattattgtgattctaggtcctagtttaatttttttaaagtaaatttacacatagaagagattgaaaggactaaaatgtaaatgatggtgatctttgggtgtgatttgcattcgtcttatttctgcagtgctcattaatgtttcaaat

SEQ ID NO: 260498 - DNA, 406 bp, Homo sapiens
agaggaggagaggggagggtggtggagaactgtcagcagctggtgtggcttctgaaccaatatgccagcctggattgccgtgtgaataattaggtgcaattttctccttggatgggtattcgatttcaaatgttacccgctcagattttgcctgggctgttgtcagaccactttcttgagaaatgtctctgatgggtatattcctagatcagagtgtgacagtatcagggaccccccagttaaacttatttcatttgattccagaaacaaacaggaactaagtgatcttagagaatgcattgctgaccttgtgttgcgcagcttcaaaataaagcaaattcagtgtctatctactatccaggggcaacaatggctgttgggcactgcctcattgattagtacattg

SEQ ID NO: 260499 - DNA, 535 bp, Homo sapiens
gctgtaagcataccagcctgcatatatggggagaggcattcattttatgatatgttttttcatttccagaaattatttttaaacgtgttcttcctccacttaaaatagaatttgtaaagcattcactgccacaggacaaagcaccaaaacacagaaaggaaacttgggatttttaaaatctaggctattgaatgtcaaaagtcaggactgcatagtaggtcctgaccaaacaacagattcagaagaatatgcattttattaataagaactgtttttcccaacctaaaatctagatacatttttccaaatgagaggcaagggtaagaggcaaaggtatctgtagggccataagacaatgtagattttattgggtccttgtgaaggggcatcgtgttggcctatcttaaacagtcctgtgcatgagatatataatatgatgacagtggcttgaacagtggtggaaaagggtcgtatatggacatgttttaacaaaatagacaacgaaatttgcatacggattgagcaagtggtgtta

SEQ ID NO: 260500 - DNA, 418 bp, Homo sapiens
gatggaagtttgaggcaggcaatgatggaagccaggaaaccaggacagtgagagatgctcatggtgttctagtaagagaggatggggctcagactagcagaatagagagaagtgattgactttctatatttctgtacacatgacaccatgccacttatcttactttctagacttctgaataaatagactttctttctgaagtcaagaaagaaaggattgctcgcctcctgcatagaagtagttttccaagcattaggaaaacaacatatcagttgatctaatgaccagccttgtgctttgtgtccatttttatggcaagtcactggggtgagaaccatgatccacaacaaagaaacattttctgctacacacagtgacatgcctgcagcctgactttgcacctcggtatctgcacccc

SEQ ID NO: 260501 - DNA, 425 bp, Homo sapiens
gctgcgtgactgttgtgagagtttcagcctggagaggaccaccctgctggaagggtgtcctgggaatgaagtccacgtaggtgagaacacacaccagggatatgtagctggatggactcagcagcccttggggaataaagccaggactgtgccccaaggaagccacacaaactgtgtagccagacagtctgtctgggaggagaaggaaggaatttatctaccagctcccatctctcatggaccaaattcttccccactgtacataactccatatcactttcagattgcataagggtgagagctgaatgtaggctccaacaggaagacggcattgaagcctggttgcttgttactactcagaatgccatctacaaaaggaaattatgtaaaaagcaataaagaaccccttttgttcttgcaggaaa

SEQ ID NO: 260502 - DNA, 580 bp, Homo sapiens
gagaatgaaatagagaaaaatcacatttaaaatatttttttctagttaaaatttaggggaatgttcactatattctaatgtttccatctaatggaaaacaagaaacatcagaattcacacacagagagacagaaacacacacacagtcccttaaaaaataaaatagaaaaaggagtaattttagtataagatacatatgacaatttgagatgtaggacaggaattctttgatattttaaaggcagggcttttttagagaatggaggaaagaaacaggtcaactgtgtttcatgcattaaacacattttaacgatttgaagctgagctcttcaggattgaatgctattatgatttatgttctaaggttggaaaattattgcctaaatgcagcaagaatattgaaaaagaaaagaaatgctggaaaaataaaatgtaaaatatataaatagcagagtggtaaatttatatgtattgactatatctagccttaagcttatgctaaatcaattttttattaatattattgactttcagggttcatatgagatgaagcactttcaataaatgtcaaataagtgtt

SEQ ID NO: 260503 - DNA, 368 bp, Homo sapiens
gattaaatggtctattaatgtatattctattagatccatttggtctacagttcagtttaagtccaaagtttctatattgattttctgccttgatgatctgtctagtgatgtcagtggaggtgttgaagtctctcactattattgtatcagtataaatattttcatagatctagtagaatttgttttacagggtgtgcacctgtaatcccagctacttaggaggctgaggcaggagaattgctggaccctgggaggcggaggttgcagtgagctgagatcatgctattgcaccccagcctgggtgacagagagagactccatctcaacaaaaacaaacaaacaaacaaaaataaaataaaatagaattt

SEQ ID NO: 260504 - DNA, 395 bp, Homo sapiens
agagacaaggtctcactatgttttctaggctggtcgtgaactcctggtctcaagcagtcctcctgctttagcctcccaaagtgttaggattacaggcatgagccactgcacctggcctaagatgttaactattttaactgtaaccctgataacaccaacctagatataactaagtcttctaagatcaatctttccttcagtgatggtgtctgatggagtgcttttagctggaagcattgaagcttgcagaaaacccaattcaactaacttaagcaatgataaatgcataatctaatacctcaagatgaaatcatgaataaggcaagaatgcatattctcaccacttctattcaacattgtactggtagttctagcccttacaataaggcaagaaa

SEQ ID NO: 260505 - DNA, 322 bp, Homo sapiens
acagaagcatgcttatgcaaatccagaaatgaaatgttaaaaattcagaaatcaaaatatttctttaaataaacttgttgagaaattttttactcagtaaacatttttaacatccactgagttttcttaattccactatttttctgaattgtcatttcttcatataaaaatatttgaataagtaaaactttatgttaggagtatatgtaagtatgtgtggctaccatttcaactaaaacttagggtgggaacctatctgaggatcttttttaaagctggataccttatagaacttgtaaaataaaaatctttttttctttta

SEQ ID NO: 260506 - DNA, 373 bp, Homo sapiens
acctgttcctttcatcaaaagctccattttgtactataaaatacagtttcatctaaaattagcaaacacaaaaatatataaagaagaaattgattatgcacatttgcagtactcaactaaccattgttaacatgtttctacatacgttgtaaaatagatctcaacatagatagatgacagataataagcatgttacttaaaaaatctgttttgattagatttatacataaactggatgtctaggttctttacctgtagatattgggattatagataatttttattttcttgtagtattatgtaattttctatgcaataatttatgtcatatgaaaaatataattaaataaaagatgaggcctgtgaaaaaata

SEQ ID NO: 260507 - DNA, 398 bp, Homo sapiens
taaatttcacatgtttaaaggaactcccgagctaaaattttaattgtctgttaaaattttatatagcagtgtttgacaaaatatggtgagagggctgcttgcaacagaattatcagatatgctcataaaatgtgaaatatctaggccttcttgtagaccagctgaacctgaatctttgagagtgagtcctgaatatctatattattaccaaactccttttttatgccctaaaatttgaaaatcattgatgtgcatgatgaaatttccactttattaagattaaaaactaggatccttttgagattgccatttaaatatcaaagaataaaggaggcactgctttccatttgtaaccttaaaaatgttaaattacctttctttcagttgagtgtgcgagg

SEQ ID NO: 260508 - DNA, 528 bp, Homo sapiens
aataaatgaatgatgagagatgtttaataaagaaacagaaaccataaaaaagaagcaaatagaaatcctggagctgaagaatacaatgactcaactgaaaagctcaagagacagcttcaacagcagactcaggcagaagaaaagaactgggaaacttaaaagacaggtcatttgaaatgatagcattagagggacaaaaagaaaaaagaataaaaaagaatgtggaaagtatacaggacttatgggacaacatcaagtgaaaataatacaggcatatgggagttaaggagaagaaaaaggggcagaaagcttcttatttttaaaaactaaaggctaacagtttaacaaatctagggaggaaaagggacatttcaattcatgaagcccaaaggtctccaaataagttaaacaccaagactcattataattaagttgttaaaactcaaaaagaaaaaatctgaaagcagcaagagaaaacctacttgtcatataatatacaaggaagcttctataagactatcagtgaat

SEQ ID NO: 260509 - DNA, 266 bp, Homo sapiens
aacctacagagagtaatagcatcataaaaacaagtagaaaaccgcactggactagtgtaagttatgagttccctgtttttttccactgtacattttgtggcgagcacaatgcatcaattacaggcattatgtttgtgatatcctgagttctggaacactgcctcaagagagttcatcaatcattgtctttttccctaaagtggtcttgcgttctctcagtctgtgggaaataattgtcaaaattaataaatgcacatgaaagaata

SEQ ID NO: 260510 - DNA, 415 bp, Homo sapiens
tttatcttaaggcttaatgtataacatgttaaaggaaaaatgaaatttagcaatttgttttcatttaattttatttcaaaaagtgttagtgttttgtttacccacagtgttcacagttcattagatctttaaaaaatctataatcttagaataagaaatactatttaatttttaagaaactgaggatgagaccattgttttagaatatgtacttgtgaatttagaatgaaaatgtaagaactggtctcaacattttttactcaaggttaatgtctccttgttttgtacacaaattttaagaggcagtgttatctggtgtccaacagattgaccataaataaattgggaattaaaatagaggcttctttagcaaagcacactaatttacagtataaagtggtaattgacactttaa

SEQ ID NO: 260511 - DNA, 543 bp, Homo sapiens
gatatggaggagcagaggccaagaccaatttttagatctgttctctccacctaatctggccccttgtctttttcccctcttgacaacaacatcaggctccaagagaaagagttctaggaccatctggcagagtggttggtgttcactttaacagtccaagtcactggaaggtagggcacaacatggttgtgccttaggctgtaattctgctcttcactagatgtcacaggtgatctggtgtttgatacaggatttgagataggattgttttcctttatggtagtggcagagctcatgtaggtaatttttactgttaacgtcagtccaattccttaatatccattattggagaaattgaaagattcatcctttgaaaatagttcctagacctgtggaggctgcatagttttcacagttcccagggacaatgggatagctattttgcacaatgactatattcatttagttatttaattcatcaatatttattgagagttaatatactatatgttagcaatggtacttgatactcaagatacaaaa

SEQ ID NO: 260512 - DNA, 515 bp, Homo sapiens
acaaaccccttccttctttaactcggtgtctgaggagttttgtctgaggctcctcctgctacaatttgttttaaaagtatctgtggttggcctggtggctcacgcctgtagccccagcactttgggcactgaggtgggcggatcgcttgagctcaagagttcaagactggcctgcacaatatagtgaaagtctgtctctacaaaaaataaaaaaattacccaggcatggtgatgcatgcctgtggtcccagctacacgggaggctgaggtagcagaatcacctcagccctggaagtggaagttgcagtgagtcatgattgtactgctgcactccagcctggataacagagcgagaccctgtctcaaaaaaaaaaaaaaaagtacttgtcagtgtctactactgtgtgctaagcactttgcttgattttgcagaaatggggcataaataagtccctgccctcagagaagaaaatatgttgggtaagatagatgaataaacacattttaatagaaca

SEQ ID NO: 260513 - DNA, 555 bp, Homo sapiens
aatgtagcacagggcttcagtgcgttttgactctcagttggatatgactactgaggagccttggcaataggttgaaaagagtgagaagaataaaaaagaaattttcccctgaacgtctccttttgaggtcaccttaggtcagctatgtccctttcccaaaggtcactcttcctctcaagacttttctgcataattttctctccttctaagttccaataacctctttctctttatctcctcatcccttcagatgtaggagtagaaacagctacaactgcctttaacagtgcaggcaggtttctgttctacccctggtagtttccctataccctgcccaaacctttgttatcagatcctttgtaaatcagtactcctgaaattatcttaattggagtgtgccatctgttttcagttgggaccctgactcatgcacttgctttttaatttttaaatgcatatgccatttctacataattagctttacagaagcaacttgaagcagaacctgcaacttacactggattcttaataaacaaacatcttttatacaacata

SEQ ID NO: 260514 - DNA, 409 bp, Homo sapiens
aattgacaattctgaaatcataaggtttcatgaaacctggaacaatttaaaggacagttttgaagaaatgaaaaaatatattccaaggttcttgaaaagtatgtgagaaataacataataagcatatagatttttttggtggggtcttaaaattcaaatcttagtagaaaaagaaacagaagaaaaaagaatccttcttgacgacaaaagagacaaaaggtctgaagagtcatggagaagggctgtgcaggcccaggggtcagataacagacaccaaaagtccaaactaatagcgttagttctgggtaatgaggaggaggggagagatactttcacaaaggagtcagaagatgagagacacactttcaaagtcaaaagattgtataggaattgggggagaaagctgaga

SEQ ID NO: 260515 - DNA, 383 bp, Homo sapiens
tgcctccttattgatcttagaatgaaatccagattcactaaagagttcctcagtcctctaggacctggcccttttttctcattgatcatactgcctgctcctattctgagggtaacaggaacctcgaggagggaggatattctgtttccctataacgttttgaagagtctcagtagaagcagcctgtttttgacaaaaagatcgtcagagtacagctcagcacattctcacagacagaatcgccctggtccagacatcgtcagcatcctggaagctgccatgccacctatcactacccccaccaagggagccactacgctgacttctaaatacagattatttttgtctgttgttgtgctttatataaaaatgtatgctctgtg

SEQ ID NO: 260516 - DNA, 710 bp, Homo sapiens
ggtaatttcaccgataaaattaatattggagaatatggcttagtttttgcaaattaaaggccaaatcaatattactcaaagtgtagacagagccaatgccactaagagagtgcatggccaagagcaaactagaacatattctcttagcagctaacagatttcaaaagagaagagaagagggtgctaactcatgcattttaagtctcttttccccaaacagccaccagaaaagataatggggcatgaaaccacaagtttaggaagatccatcccctaagagctctatgaataaacatgccaaattacatgaccagaacatttaacttgtaatctaatatcaacacatagatttatggtaattcttacaatttcttcaagaacaatgagtaagtagctgattttttcacacagacactgtgatttacagaaataagaaggaagacaaaataaacactacttatagtccactcataatggtatggaattacacatagaatttaggaactttgttatatttaaatgtgtttatacatttaaccacatacagtattttaataacaaaatgaagtataaagtataattttaatactagttcctaaaatattccatttttaaataatttttaaaacaatgttaacttttcatgtctcctgtctctatttttctattatgcttctaatcaatgtccaaaagtattttcttatattctt

SEQ ID NO: 260517 - DNA, 381 bp, Homo sapiens
gagatgctaacttgcctcagaggctggggtgggggtttgggggaaaataaaagaaaaatacttgctttatatttcaaatattgctgggcattttcaactcaagaattgaataatatgctagactaattacttcttatggtgtattaaatcttttaggcaactagcaggcacacaagatttactacttaagattatttaatctgtaatcccagcactttgggaggctgaggcaggcggatcacgaggtcagatcaagaccatcctggctaacatggtgaaaccccgtctctactaaaaatacaaaaaattagccgggcatggtggcaggtgcctgtagcccagctactcgggaggctggggcaggagaacagagtgaacccg

SEQ ID NO: 260518 - DNA, 494 bp, Homo sapiens
atcacaaaaaatcaaactcagtgtatcatattatcacatcatttctttgtgttctggatgctaggatactggtaaacaaagtaaaccaaaatttctcccctttatattttatatttatagagtgtaagatggacagcaatctaatcaaataagtaaaacttaacgtgtatagatgtaattatatatgaagagtatgttggctgatgtgctatggtgaaaagcaaagcagggttgcaaggatatgagtaaagtgtgggaattacaattttaaatgatcagggaaagtctcattgagaaagtgacttttgagcaaagatgtaaataaggtgagcaagactgctatgtaggcatccagtgtaagagtgttcccagtattggcagaagccagtgtaaagccccctgggcaggagctacctggcatacttgaagaacagcaaggaggctcatgtaaagttataatagctcgattggtgggggaggggaggtcatatgag

SEQ ID NO: 260519 - DNA, 386 bp, Homo sapiens
aaaataaacaaatagtacatttatggtaagcttgacacctttcacacagctgttaacattttctctcatctctgtgtaatgttctgtatgtttcatgaatgaagaggtacctcatccaacataataaaattaagtagcactttatagagcatgctacatgccaggcattattctaaatattttacacattgattattttaataatcagaacaacactatatgataaatactttaaatatattaatatattaaaccattagtctctgatttaaatacttataggtgaggttaacacagcctataaacaaatatttgtggacttcagaacaaactgaaagcaggttctaaatgtcaaataaaatggcttataatatgtccattggatc

SEQ ID NO: 260520 - DNA, 438 bp, Homo sapiens
cctaaaggagaaacctgaatcattacatctcctctcctcgctacaaatgcaaggcatgaatcagttttagactggagttctggatatgggtaccaatgttgctgactgcaagagcttccagccaatgccacctcagggggcaagcctacctcaggcatctcctcatcttcatcttctgaagacacgtcttcctgtgtgcactgcagcaaggaagggaaagatggagatcagagccccagtggcttgctagaatgcagcctccaacctactcccctgagcccccaggtctggaagttgtgcgcctgcctgtaatgctgccagtctctccaccagccagatctgagtggaagcaacagcccagggaatggctttgctaccagcccattatttttcgcctatcactgccaaagaataaaagaaaagcaaaatggctgtctc

SEQ ID NO: 260521 - DNA, 535 bp, Homo sapiens
caggatattgtaccgaaaaatccagatttctctaaaatggccccataggcctggtttcctgcatggctgcccctggctgaagaatgcttcattcggtctgtccagtctctggcattctgtggtttccctacagaaaccacgtgtttgctttttttatagtagagaaatcttaccactatctctgtgtgttaacaatctggctcctgctttgaggtgcaccttcacttaatggtgcctcgtaaacagattgcagcagtgagatcagccgggcttcagctgattaaacacccagttgggaacacccagctgggaacacactgtctctgttctttactaaagcaaagtccactctttcacaccggctcctctgctgtcctatcttacagaccttggctttcttttccatctctggacgatgttgatcctcacctggttctagttcctgccttaccttattctaatattgatggcctgcttctggcaatttacactgccttgtttcacttcacttcatcttgtttaacccctaaatgca

SEQ ID NO: 260522 - DNA, 530 bp, Homo sapiens
ctgtattataaattaaaacaaagcagtttacccgttaagaactgctgtatcagacccatgctgcaaatagtaacatcttttctagactctgaacctgaatttgttttgatgatttttgtagccatcaaagatgagaaacttctcatctcctcctaaacatttgttttaaacccaagggcttcttttaagccttagcctgtatgtcttgtgatggtgacttgctaaataaaaggctgatctgggccgggtgcggtggctcacgcctgtaatcccagcactttgggaggccgaggagggcggatcacgaggtcaggagatcgagaccatcccggctaaaacggtgaaaccccgtctctactaaaaatacaaaaaattagccgggcgtagtggcgggtgcttgtggtcccagctactcgggaggctgaggcaggagaatggcgtgaacccgggaggcggagcttgcagtgagccgagatcccgccactgcactccagcctgggcgacagagcgagactccgtctcaaaaaaaa

SEQ ID NO: 260523 - DNA, 144 bp, Homo sapiens
ccagtgttactggaccaaagctccctaggaagctgtatatttgtttgtgtgtgtgtgtgtgtgtgtgtctgtgtgcacgcacacacacatgcattttctggtctgtgaaataaaccacgaaggaactgaaaaacttgccttcta

SEQ ID NO: 260524 - DNA, 443 bp, Homo sapiens
cggcacgagggaggaaatgcttcctggacctgtttgaatggaaaactgtgtgtactctgagttacagttaataactggaaatgtaataaacatagtaacttgagatgatggcagtattcccagatgtataggatgcccagattttggttcatagagttaatgagctccaggggaactgccgtcacttgtcattcaggcaaaagagaaaaacaacaacaaaaaaccctttaggctaaggaagtctcaggatttctgaaagtttaaccaacttcagtttgagatttctatttgtcctttttatcttacctgaaggctaagagtgataaaggcaatagagattttgagtgagaggtacagatgctccccgatttatgatggggttacatcctaataaacccatttaagttgaaaatatcataagtcaaaaaaaacgattgcggccg

SEQ ID NO: 260525 - DNA, 465 bp, Homo sapiens
tcaaaaaataatatggaaaggaaaaaagtagttctggagttcataaatggtttttccttcttaggtatcaaacaccttgcctataaatgtctgacaccaagctgtctcccacatactcattgctcagggaaaccgtaagatatttgagatcttctgtaatcagctgtagtactataaaactttctgaataaacctgctagtcctgtggcctgtggctaccaaatcatgtgccaagatgtatcagggccccatggaggaactcacaactaccttgggatattttaaatttcagagtaattcagtgatactcaacataagccaagacactaagcaaactattagtttcaggttgttcagtttcaatatgagattgtactgcaaacccctccattaagtttcatcttctaaaaactgaatttctggtggttgctataactcaaaaaaacacaggtacccaccccacca

SEQ ID NO: 260526 - DNA, 654 bp, Homo sapiens
cttatgagtaggcctgtaacacggacgtgtgagaataaacgccagagaaaaatttttgatggtattgacatggaatgcatctgtggcacaggccagcgaagagatgggttggcttcctcttcgagtcagagcaaaaggatgtggcaaaaaagatctaaggatgccatgaggaattccatgtgtacgtgcaggtcgtgtggctggtctacttgtgggtacaaaggcccagacccattgtttcaactggagacctgtgaagggcgatcccagcctcagaacctcgcatgggatggactcagtactctgctgcaactgcatttcagtttaacttctccctctacccagtcctaacttccttattccctaaaaaatgcttctgggagtgctcctcagtaaacttcatgcataaacacttcagaggctcagagtatgtttcctggagaattccatctgtggcgtttcctcttcatgcctactgccaccatccaggtttaggcccccattaccgcttacctggaatattgcaaaagctttatcactattctctttgctcactggctctcctataatcagtctacacaacagcagactaattttttttatcccagatcatagctcttatgctgttttcctgctcaaaaactttggtggccc

SEQ ID NO: 260527 - DNA, 515 bp, Homo sapiens
cttatgagtaggcctgtaacacggacgtgtgagaataaacgccagagaaaaatttttgtggctggtctacttgtgggtacaaaggcccagacccattgtttcaactggagacctgtgaagggcgatcccagcctcagaacctcgcatgggatggactcagtactctgctgcaactgcatttcagtttaacttctccctctacccagtcctaacttccttattccctaaaaaatgcttctgggagtgctcctcagtaaacttcatgcataaacacttcagaggctcagagtatgtttcctggagaattccatctgtggcgtttcctcttcatgcctactgccaccatccaggtttaggcccccattaccgcttacctggaatattgcaaaagctttatcactattctctttgctcactggctctcctataatcagtctacacaacagcagactaattttttttatcccagatcatagctcttatgctgttttcctgctcaaaaactttggtggccc

SEQ ID NO: 260528 - DNA, 376 bp, Homo sapiens
cccaggaggcggaggttgcagtgagcgagatcgcaccactgcactccagcctgggtgacagggcaagactccgtctcaaaaaaaaaaaaaaaaaaaaaacaagatttttgcgtgttagactcagttgtccggaattgattttcacagttttctaaaattcaggctcaattcttagatttctgtcatttgcaacataaaatcaaagtggccttcagtttatccaaattatgaaaaaggtagattttcatgagcagctgtcaaaaggacatacaggggcctgtgtgtttgctttttaggaccccattatgttcagacctaattgaagctcagcaatttattaagtgtcacaatcataaaaatgtaaaaagacaaagac

SEQ ID NO: 260529 - DNA, 382 bp, Homo sapiens
  misc_feature (3)..(3): n is a, c, g, or t
cgngcccccgaccgcgcgagagagacgagggcagaccggacccacacctgctcctggccttaagatattttttatatcaggtcacgtttgttttatctagggggcaaaccttccttgtaagtaatgtttttctagtgatgctgcactcttggagtcagttatctgtcacctgaatcttcagggactgttttgggctgtcctgaggggggatgcgggggggtggcgtagcaggagttactactgatgggactgctgcccctgtaaacaggagaaccactgctcacagatttaccaaaggtgtggggtcttgagccccaaaagttgaagttgcagtgagctgagatgatgacactgtactctagtgacagagtgagacggtctc

SEQ ID NO: 260530 - DNA, 681 bp, Homo sapiens
gagagagggcagggcagagtcactgtctggggaagctcacctacccacaccacccctaggcccatcagcctctgcctctccttcatgggccccagtctaatcccctgacactaagctgtccctgatgaattgcatctccccaacacccccaggcatgctcaccttctgacactccaatctctgctattcctccaagtctgaccccaaaacatgcccatttctgcccctgttcacatcctccacccctaccctgtcttggagggagtccttctgctgggaagaaggtatggcatgtggtggcaactaaggtcccaaagctgtatctgcccttttgacctgggccttgcctgagagctgagctaagctccaatttgtgaatatttgtagggactaccaggcaccaggctccatgctgattttataggaggtacagggacatctaggtagggcagtggaaagtacagggactttggattcaaatggacccaagtcacattcctggctctgccactcactgtgtggccttaggttattcaacctctctgagccacagctcccctcatcaaaaataggagtaaaaatccctgccttagagagttgctgcacacagacaaatgtgcacacagctgccccagaaagcaagatgagaaagaggccctgggggaggcacaagtgttgtga

SEQ ID NO: 260531 - DNA, 340 bp, Homo sapiens
tttttttcaaaatcggtattaataccattttacagaggaaaaaaattaaccagtaatttttttcaaggcctataatcaatgttcacgatactaaaaggcatttcttcagaataaagatgatactaataattattgaatggcctattatgcaaatgacaactggcttaaagtgtttaacatgccccatggcaaaaaaggtgaaagtgcttaaaagcacagtaaaactacctgtccatcacagtagcctctaacttcatgtagcaattgagtacttgaaacatagctagtctcaaattgagatgtgtcgtaagtatacatactagattttaatgacttaata

SEQ ID NO: 260532 - DNA, 421 bp, Homo sapiens
actgtggaaatgggagctaatccctgtttaaccagctactgcctggtcagatactccttagagcataattttgctgagttatgccccattccatctttgaacccatgctagagtctccccctgcaagctaccctctctatcagctacttcattccaacagctactccttccttccagcttcccagtacctgccagggtcccatgagacaggggtgtcaccttcctcaaggctgaagacacagaggacatttgttactgactggttctctggccatgggtaaggacaagccagccctccatagaggcatgacaggctcttgctttcaaggaggcagagctacttcagaggcccaaggacatcttctcactccagacagggcatttcccagccaaagcctcagccttctaccttcaggctttc

SEQ ID NO: 260533 - DNA, 424 bp, Homo sapiens
tggtgaaaagacttgatctttgttctcagccaaggagcatttagtgacaaataatcattataacacattgtgataaattatttgctgagttgttcatgtgttttacaaatatttactgagaatctgctatgtgccagatattaatacaggctgtgggtttatagcagtgaataattccctagtctcatagagctaacattttaatgaggagaaaaatgatgatgtggagggagtgggagagtggagaaatgctaggaagataaattagagtaagaaaatggagcttgtcagtggaagggtgttgcctttttacagtggtcaaactcttgttgtaaggtgacatttgagccaagaccttaaagaaattgagaggataagtcactcaaatatctgggggaaagtgttctaaacagaggcagatata

SEQ ID NO: 260534 - DNA, 306 bp, Homo sapiens
tgacttcccaaatctgaatgcagcctgacctaaattagcacccaatcctgcttacactttccagtccagactactatattggcctgccataaaaattattttaaaaattaagaatttatatctcaaatataaacagttactagaattcatttagactgaaacagggcattataaatttatgaacaaattaattaccagtttcattaatgctgtttttataatgagtaagtaatcaagtccaaaactttactaagtttgtacccaatctaggagaggaaatacattagaaaacaaacggccaaaaaa

SEQ ID NO: 260535 - DNA, 544 bp, Homo sapiens
cagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacatttt

SEQ ID NO: 260536 - DNA, 453 bp, Homo sapiens
tctgtggttttggaaacttctaggtctctgtgattcatcatctctttttgtcttgcattagcgacaatatattctggccaactgatgatggaaggagagccagagagccaatctgcaagtttatagtcagtgccagatcagatcagtggtaatactttcaatattctccctctgctctgagggtgactgctggggtgtctgtctttcactctggacttgtgtgcccttttggccttctttttcaacctagtttttgttttccttggcttaaacattttatttattttttccatcgatatcaaaataacacacgcagctgggtgcagtggggtgcacctgtagtcccagctactcaggaggctgatattggaggattgcttgagcccaagagttcaaggtcagcctgagaaacatagggagacccccatctcaaaataaaacaaaatatagtaa

SEQ ID NO: 260537 - DNA, 438 bp, Homo sapiens
tctttctcaactaggtttcctatttcttttacttttttttttaaattaagacagagtttcactcttgttgcccaggctggagtgcaatggcattatctctgctcaccacaacctccgcctcccaggttcaagcagttctcctgcctcagcctcctaagtagctgggattacaggcatgcaccaccaggcccagttaattttgtatttttagtagaggcgatttttcctccatgttggtcaggctggtctcgaactcccgacctcaggtgatccgcccacctcggcctcccaaagtgctgggattataggcatgagccaccacacctggccttcttttaccttttcttggtcgagaaaccaagtgctggctcttcctgctcctcagccatgcctcacctctgtctagttgatttctacacttttgaaagggcaccggga

SEQ ID NO: 260538 - DNA, 502 bp, Homo sapiens
tttgtggagatgaggtctcactcctggactcaagggatcctcctgcctcagcatcccaaagtatgccactgtgcctgtgccattgctcttaggaaaacagtcctggctacctgggtgagaggatttgggaaaactgaggtcagactccaacagacagtggcagcaaacctaagcctagcccactcaaaggaaccaaagctggccgaccctggtatcgtatgagtgaatgtggagaaaatcagtgtctacctattctggctctactgagaatccccctcaacccactgcatgggtaggaaaactgaggcccagaccagaaccatgccttaagaaggccacagggccaagggacccaggattaggtcactaggatgtggttacctgtataatgtcacagggttggtctcacctactagccagcccaactcctgcctccttcaatttcccagaaatctggaccccggctccctaagaatctaaagacctactccatttgggaaaa

SEQ ID NO: 260539 - DNA, 540 bp, Homo sapiens
gccatgatgcctctcttgagggaaaggctgtgggtgggtccagcccatgggtggcaaaatgtggagtcttcactgcttcccctttagtgccatttgcttttttaatttttttctttaatgttttcaaaggaaaatattaatacaaaaaagaaaagaagcaaatgttctgcctgaccttgtcaaccacacctaggcattaactcttaaaattcttgcagtttgcagaggaaaagggagtaagaatgaacaagacatgcatgcgtgcatcgcggccagccttgggtcagaacttggacagattcagtagttgaaccattggctaaatggcccttattcatttttcggggcaaaacccactaggaatgagtgtatagagacctgtagaagcaaaatgatttcttcagcttggtgagggcctcaatgccccaatcccacctcacaccctgtctgctcgatctcactgtcttcttcacttgtaactctgtgtcttagtgctgaagtttattaaagtagagcttacagctcttttcatagcacctg

SEQ ID NO: 260540 - DNA, 425 bp, Homo sapiens
tgggatgaccacaggatggcttagaatctctgcctcagagtaaccatgactcacctctggcactgggcacaccctccctaaatctatgattccatctggatcccaaacaaattggggttctgttacctaggggaagaggagatggctgttgagtagacaatcaacagtgtccaccacattgccatacactgcactccccaacccaacctcacttgcagaggaggaagggggctcgtagacgtttctggaaggtgatggcaggagcacgagtgagaaggaagttgccctgcctgggcactggtctcagactggcctgacaagatgggaggttgtgtgatgtatgatgaagcctcactattggacagtttgtttttgatacaggtaactgccagtcatatcatgacctctgggacacacacatacta

SEQ ID NO: 260541 - DNA, 411 bp, Homo sapiens
tggtacatcaagcattatgcttgtcatttaaatacaagtaggttctaatggggagatctgctctcattgtgagaacaccttaaaatggactcagcacttgggatcaatctttaaaaacaaacaaattaagtctaactacacactatgttaatgagaaatgggtgttttactcaaagtgttatggaaacactggggagagaatttacatgacatatgaaaaagcaaaacttaataagattcctcatcacccatccccataggacttctgtgatgacacctcttttgcctttccttttccttttgcttttctccctgaaccttctagcgtctccttagtcactgcactctcatcctctattaatgttctgcgtgctgcaacatgcaaagaaataaaacaacggcatcagttta

SEQ ID NO: 260542 - DNA, 364 bp, Homo sapiens
ctagacctgtggattcttttgtgtgcccaagactaaatgcagggttgattccactatgacatttttttcctggtagccttttatgtccccaccctctaaagaaaaatcaataaagcaagaagacactgatttttaagagataggactctcttttcaaagtagattacttgagaggtaataaatttaattatacataaaagatcatacacacacacacacacacacacatattcacctttcattttaagcaaaactaggaaaataagagttgaaggtaaaactccctagttcctagcaaggtaagctagcgaacctgagaataaaagcaatgtcccaattcatccaattttggaatattaaaaca

SEQ ID NO: 260543 - DNA, 316 bp, Homo sapiens
aaagacaattcaataggagtaactgctttctttaacattttggccaatcccaacctcagcatgtgctcaacacaattttcacaatatggaacaccacctgtaattgttcagtacaagcaattctatcatcttgctactcaaaatctgggctgagaacctgcagcctcagcatcactggggagtttattagaaatgcagaatccagtgtggtggctcacacctgtagtcccagctctttgggagatttcggtgcgagcatcgattgaggccaggagttcaagaccagcctgggcaacatagcaagaccttgtctcta

SEQ ID NO: 260544 - DNA, 471 bp, Homo sapiens
gctgtctctgaacggaataaatctctgatagtatactaagagcagccttttattgaaagcctatatatgccaggctgtgggctaggcactgtgtatactttctgattttcactacagctttgcaaattgtttctgttaccatgtgatctatttgaagcctgaagatcagataaattaagcagtttgcccaaggacataggtaaagttaaatggtagagatgggattccctggactttgaattctctttttgtttccttattttatttttgagaggggttgggtatgttgtggcttgatggcaggatcttttgtaatgaaggctagatggaacatttaaaggggaatgtttgaatctgaattatagtagcatagaaggtagagttctttttgctgaaaaataaaaacagaaaaagcattagccttcatcatcaagaatgatcttggataaaacaggttagcatgctggttat

SEQ ID NO: 260545 - DNA, 383 bp, Homo sapiens
agtagagcaactgaggctcacagcagttatgtaacctgcccaaagtcacacagcatgatggagggtctggattggagattttgtctgactacaacactcatgtatcaaatcctattcagttttgatgttaaaaattctgtggttgaattcgtcacagtgtctttaaataaaacaacaacaaacaaaacacagcaaaccttaacatagttgctaatcatatgagtttacaaggccacctgtgtctttactatcagttacactccttcccaccccatcacattaatcactcaggtctagggatttgcaagtttgctaacagccgaatggaacaaagacaaaacgctaaaatttgtgatgtgggcctaactccaaagccttcaaga

SEQ ID NO: 260546 - DNA, 426 bp, Homo sapiens
ctatttctatgttttttttgtttgtttttttgagaccaggtctcattctgtcaaccaggctagagtgcagtggtgtgattgcagctcaccatggtcttgacctctggggctcaggggatcctccagccacagcctcttgagtaactgggactgctggtgcacactgggttaatttttaaagtatttgtagagaaggggtctccctatgttgctcaggtcagtctcaaactcctgggctcaagtgagttgagctcaggctcccaccccggcctttcaaggtgctaaaattataaacatggaccacctcaccctgcctatttctaggtatgtttaatgagaatacttttagctgcaattgtaatcactactagtcatcttgcaatctaggaaacaaacatagatttagaatgacaaaataatgcttgg

SEQ ID NO: 260547 - DNA, 665 bp, Homo sapiens
attttcttgaagaaataaaattcgctttgcaagatgataatcttgaatgccatggctaggtaattaaacaattaatataaactctgttctctttaatgaatatcttttttttgcctagtgcttcaactatagttttacagtgaaatgaatgcttaaaaattatatattttaatcttctatgttctgtatagatctgtttgccaactaacgtggggatttggtaattacaaaatattgtaactggaagggcattaaaaatccaacaccttcattcaggtccgataggagtgggtggtagagatgggagtagaaccagacagcctttaattcatttgcctctactttgtggcatgtgatagggacatttgatttactgggacataggtttgatgttgatcatagatgagtatcctttaaaaaacctttaaaaacttcaacaaagtgatttttttccaacacttccatccagaaggtattgcatatctcagctgactctcatataaaattattgttttggacattcatccctaacaacctttgcatttataatattcaatataatactgccctcagtgtcctcatctataaaatcaggataaagaacacatactttctagggccagggtgaggattaaatgtgttagtataagcgaagtgcttagaac

SEQ ID NO: 260548 - DNA, 689 bp, Homo sapiens
gtgaacctgggaggcggagcttgcagtgagctgagattgcgccactgcactccagcctggacgacagagtgagactccatctcaaaaaataaataaataaataaataaataaataaataaataaataaatacaaaataaaagaaataaagaatgagcaaaggaaaagatactgtgataggcagaatggcctccccaatatatcaatgccctaatcccaatgacttgtgagtatgttgtgttacaaggcaaagggactttgcagatataaacttacgtgtcttaaaataaggggattaacaaaagttatcctggtggccccagtctaattacatgagctgctaaacgcagagaagtttctccaactggagtcagaaagatgaagcagaaggaaaagttggagactttgaaagcctgagagagatttgacccattgtggttggatggggcacatggaaagcagaagaggaatgtgggcagccatggaatcaaagactggtcccagctgacagctggcagcaaaatggacctcagccctacagtccagtacgtggctgaatgccctgggcctctgaccagcagaactgggcgacagcaagcctgtgttgttttaaccacccagtctgtggtaattaatcacagcagccctgggagactcgtacagaaactgaaggtcagaatgggcatgtcg

SEQ ID NO: 260549 - DNA, 692 bp, Homo sapiens
ggccatttggggcctatggtggaaatgggaatatcttcaactaaaaactacacagaatcattctgagaaacttcatggtgatgtgtgcattcatctcacagagatgaatctttcttttcagttagtagttttgaaacattctttttgtagaatctgcaagtggataattggagcgctttgaggcctattgttcaaaagaaaatatcttcacatgaaaagtacacagaagcattccgagtaacctctttgggatgtgtgcattcatctcacagaattgaacctttcttttgattgagcagttttgaaaaactctctatgtagaatctgccagttgatatttggaggtcttagattcctactgtggaaaaggaaataccttcacataaaaactgcacagaatcattctgaaaaatttctgtacaatatttgcattcatctcacagtgttaaacctttattttcattcagcagttttgaaactttatttttgtagaatctgcaagtggatatttggagtgcttcgaggcctatggtggaaacgggaatatcttcacataaaaactacacagaagcattctgagaaacaactttgttaagtgtgcattaaactcacagagttgaaactatcttttgattgagcagttttgaatctctctttttgtagaatctgcaagaggatatttggagcccttt

SEQ ID NO: 260550 - DNA, 432 bp, Homo sapiens
gttctcgaaagcagtcctagtctctgagcaatgtatttgtaacctagagaatgcctgtgattcagctgctcaactggctcttcagacatccccagatgcccccttctctgccctgggcccagcttcctacctccagaatgcagctggggaaagagccgcaaaggctggtggtctggtgacccaggacatggaggtgcctctggaccctggcaactccaactagcattctaggaggacctcccacagtttctggagaagattctacaaaaggtctttggccagtaactaattcttcaatgtgaataaatgatagtttttttcctccaataaatgtcaaacagtactagttgggggtgggggcagtgggttgtgtcagctttcaacttgtggctgccagaactacaatgcttcttcttggttggtaaaatattt

SEQ ID NO: 260551 - DNA, 446 bp, Homo sapiens
ctttattgccctcgccaatatgaagcctgccagtagacaaggtccacccatatttgtttgaaagacctcaccatgaaataaaagataacagcagaggggactcataatttatatcctagaaaatcaacccagtccactattcttcttcataagaagacagccaaagataacaaaaaacataaataaaaccagcagcacaaaataactaaaacaagaacatttactttagaagaaacagataattcagaaaaaggagaatgttaaaagaacctagttatgcaattagcttgaaaatttgagaggatattgcatcgaaaaataagactagaaaagtacaaaagaacaatggagaacaaaataagatattttgtcttgaagatgcaattgcaaaaattcagacagttacgaagatgaaactaagaaaatcagaacaagagaaaaaagac

SEQ ID NO: 260552 - DNA, 709 bp, Homo sapiens
atggctctctgcagccttgacctcccaggttcaagtgatcttcccacttcagcctccgaagtagccctgactacagctgcacaccaccacgtctggataatttttaatttttttgtagaaacagagtattgctatgttgcccaggctggtctttcttgaactcctgagctcaagcaattctcctgccttggcctcccaaatgttgaaattacaggcatgagccaccatacccagactctcttacctgtctgaatgggcaaatggccacctccaaagtaataacaagtttcttttcatattttgtagcctctcccctcccaagtgtaccctttaacaacttagaggccctggtgacctcacaggactcattccgatcatgaataagaatagagataatgggaaagaaaatctttactactgctcaaagtggaacatctatatgagaaaaaaattaaggagacgagaaatagagttagatacttgataatatagtactagtcagtacctcatccaagttcaatgagcatgaaatttcatggtaactctgccaccctagatgaaggtttctcagccttggcactggtgatattttgagctggacaatactctgttgtggggagtgtcttctatattataaggtatttggcagcatcctggcctctatcctttagataagattgacaccccttcccccagtcacaagtatcaa

SEQ ID NO: 260553 - DNA, 419 bp, Homo sapiens
caatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatacta

SEQ ID NO: 260554 - DNA, 666 bp, Homo sapiens
gccaggtacactgtacctggcgcttacacatagttcttcatttgatgttcaccgggaccctgcaaaggaggtgttcaaatccttattttagtgattgggaaacaagctggcggggtcaaggactcatagccaacgcatggtggaaccacgtttaacctccgtacaccctcttttcatttgtcaaattgatttaaaaaatttaaattattcattcgttcgttcactcatggacagagctcctctatctgactcagagtgttttgagaggggaggtagccgggtgaggggccatgcagcgttatggccggagatttggagctgcgtctcgatcctggcctgctacttacctctgatatgattctggagatactttgtgtgtcagtttcctatccagaaaacgggaatcaggcttagcaaagagatgatgtggtgctgttcttcaaggtggaaggttgcatgcgttttggttttgattcccagtgtctgcaaaaaggagctgttaggacagaggaaacgggcaggaagccccagctgttcccttcttcctctgcttgcatcattgaacgctgccttgtgcctggctcggtcataagccgttggtacatgttacttcctttaatcttcactacagccttataaggttggtagtatcaccctcttttcaca

SEQ ID NO: 260555 - DNA, 695 bp, Homo sapiens
agctctctctctctctctctctctctctcctcgtgccgaattcggcacgagagggaggtaagtattcacagctggagttttatgcttcacacattttcatgtttgagaacaagaagcaacccctaggaaaacctcctccggcatgaagagaggctgaacaatgcgcttctgtagctagtggcaggccatggatatgatgaagtcacagatatcggaactgaatgcgagatagatgccagtgaaaccaagacaaaaactttcaaggaatccaagtgcacaggttctcagatcaatcacaagcgatgaggttgtcactgcacagaggggctgaaaagcagcatcaaagccactaaagagaggggagaagcttttgttgggccggcttttgtcttcataaccagcattggaagccagctcacatcaactgaaaggccgagttaatctatttctagtgaacattgttcgactgtgtgtagttagcccgtaatcattaaagaaaaataactaggttggcatgaccaaaaaagcattgattttcctgtggagcacatttgtatgagttgaattttttgcatatgttattgtgcgcatgagagagaagaggtgactgacctcacaaaacaaatgcacacagcagcgctgcttcttagcctccacaatgaacttggtgtttgtagagcaagacgtaagatggc

SEQ ID NO: 260556 - DNA, 431 bp, Homo sapiens
cctttattcacttgtcttgtttaactctcagcaaatcaagtacctcatccccatgtcacagatgaggaaaatatggacccagtttgcacagggtaaaaggtttcacgccatggccatctactctggagtctgagttctttctattcatctttgaatcagcagtttctttatctccactcaggctcaggagaaaatggaggcaggggcgtgcgttcacagcccccctcgatttaggcaccttccaagcttggggtaaaggtaggacctgggagtatcgccatcaacctcttgcactttatgctctagtagtttcctacttcaggcctccatacctttgcatatgctgttccctgtgcctggaatgttctcattcctctctgtctgcctggcaaactcctattcatccattaaaacccaaattaaccagcacc

SEQ ID NO: 260557 - DNA, 487 bp, Homo sapiens
ctgctttcttctgctgccttttatgctccttgtgcacctcccttccccgcaacctgggatgaaatctccccacgtgctggtgttcctttgcctcctggtggctctggtcaccgggaacctggttcagtttggggtgatgatcgagaagatgacaggcaagtccgccctgcagtacaacgactatggctgttactgcggcatcggtggctcccactggccggtggaccagactgactggtgctgccacgcccacgactgctgctacgggcgtctggagaagctgggctgtgagcccaaactggaaaagtatcttttctctgtcagcgaacgtggcattttctgcgccggcaggaccacctgccagcggctgacctgcgagtgtgacaagagggctgccctctgctttcgccgcaacctgggcacctacaaccgcaaatatgcccattatcccaacaagctgtgcaccgggcccaccccgccctgctga

SEQ ID NO: 260558 - DNA, 194 bp, Homo sapiens
gtgagatgagttagtattttaccttccgttatgctacttaactgtccgtgagactgtggcaagttaacctattttagcctcattttctccttatgggaaaggataagaaaatctatccttaatggttgatcaaggattaaactataaagtttttagaaagcattggcaaagagatggacatttaatggtagatg

SEQ ID NO: 260559 - DNA, 174 bp, Homo sapiens
ggtgcatgggtggttcagtggtagaattctcgcctgccacgcgggaggcccgggttcgattcccggcccatgcagcacgaaaatgtgttttggaccgtgcgcgggaggttgcggtaagccgagactgcaccgttgtattccggccacagcaacagtgagagaaacttcgtctca

SEQ ID NO: 260560 - DNA, 393 bp, Homo sapiens
ctatttgcttttcaggcaagtgttctagaaactattttgtgtccatgtctgtgaggaaagttggcctgtaatttccttttcccatgatatctcttctggttttgagcttgtggtaatggtggcctcgaaacttgtatttctgggaagagtctgtgtagaatggatattatttgttccctaaatgtttggttgcattcaccagggaagacatctgggccaggaattgtctttgtgggaaggttttagttgtatatggaatttctttactagatctagggccattttggtgatgaaacttcttctgccagatccaacaattagtgtctttcaaggaatttttctatgtcatctaagttgggaaatttgtggtcataaagctgttaataaacttga

SEQ ID NO: 260561 - DNA, 319 bp, Homo sapiens
ctctttttttctggctcactctgtctccctttaactctctctgtctgtctaatacagctcttttctttaccatttttcctccctcatattcaaatggtgccagctggaagaagccagctgaagcaggggcaggctatgctgctcagcagtgtctgctcttctgttagtgatgtttgtgtccagacaccatctgagaggggtcttttaaaaagggcagtatgtggctctgaaggataatgttggcaaaggcaaataagaaaaaggacataaaccattttgtaatgttatgtttatttccatttgggtgtaagttctcatg

SEQ ID NO: 260562 - DNA, 388 bp, Homo sapiens
caggagactgggtcccgtcggcactgtggggagcccagcctggggtctggccctagtggccgctccattctatgaagaatgaacagaaagggtgcaatccgtggatctgtggtcactgacccagagccagagggacactttgttcccacacaaccagtcctctgtcactctgcacttggaacccggtgtccacgccctgtcccccaggacgttcctctcccatgccaagactacagtgcccaggagtgcctggccccaaacccagccctgacactattctctccgtgttgccctgagcttctgcctgaagtgttcccatctgcagtgtggggacggtgagacctgccctgcagacctgaggctcagaaagacctcagctctagggaca

SEQ ID NO: 260563 - DNA, 708 bp, Homo sapiens
aagatacggagaaattggaatgatcatagattgctggcgagaatgtaaaatggtgaaaatacttcggaaaacagtttgacagttcctcaagatgttatcagtctgtccattggtgagtgaatggataaataaaatgtggagtaaagatacaagagaatacatttcagtatttaaaaagaagttacttttgtcatttgcaatgacacagattagcctggaggtcattatgctaagtgaaataagctaggcaaagaaagacaaatactgcgtaatttcacttattatctggaatctaaaaaagttgaattcatagaagcagagattagaatgttggctgcccaggcctgggggtgggagaaaggtagagggaaatgctggttaaagggacaaagtttaatttagacaggataaacaacttttggagatctattgtacatcatagtgactacagttaatatatgatctacttgacaattgctgaaagattagatcttaaatgtcatcacacaaaaataataagtatgtgaggtgatgggtatgttagttatcttgatttaatcatttcacagtgtgtgtgtgtgtgtgtgtgtgtatactgaaacagcacattgtaaatccacaaatatatatgatttttctggcactactccttacgctcactgaatatctcctcttaaccaggcgccgtttcttgtgttttctctggcc

SEQ ID NO: 260564 - DNA, 518 bp, Homo sapiens
caacatggcaaaaccccatctctacaaaaaacaaaaattagctggatgtggtggcacatgcctgtggtcccagcttcctgggaggctgaggcaggaggaacacttgagccctggaggttgaggctacagtgagttgtgattatgccactgccctccagcccaggtgatagagtcaccccatctaaaaaaaatgtgtaataaaaacctacagaatgcttgaaaaaccatcaaactactatgtaattgttgttatttttaaagaaagcaaaaatacaggtgtgaaaactattatggtattgctctgcagttatcacatcaaagattcaagctagaaatcctttacagtctattcaacatcattggtcaggcattctagaatatagtggatgtgatcatccctttgttgtacagacccattaggtttccaggatcttttgttgtaagtccaatacaccagcaatagatttaactatatcaaaatgccaagattaaaaaaagtctctttgcacccaacattg

SEQ ID NO: 260565 - DNA, 947 bp, Homo sapiens
catacctgtaatcccagctagttgggaggctgacacaggagaatcgcttggacctgagaggaagacgttacagtgagtcgagatcacatcattgcactccagcctaagtgacaagagtgaaactccttctcaaaaacaataaacaaaaaacaaacaacaaaaacacaatacaagaaagtggtatagtatatacagaaactctctaatatcctttctactacttttctataaacctaaaggtatacctaaataaaatgtttattaaaagctaataaagcgtccgaaatttatatataaacatgtgcataaattcatttaaataaaaaaattgtagtggctaggtacaactgagcaaagaagtaaaggtaaatgtgaggtatcggttacaatacaattcaaaaagataaagagatgaaaaatgtaaaagactgcttgaaagctggataatatttcagaagagcaagggtaacaaaaataaaacatgaaaaaattataatttaccacatttgcatacagaataatggtgaaaaattatgtgatcatcttaatagattcagaaataaaaggataaaatttatgctcatttattgtaaatgacttaacaaatgaatagaaagaaatatataatcagataaagaaatttttaaaaatcataatggtgaattattttctgtgtgtcactgggaagtcatcaggaatgccagttataaccactgctattcaattctatactggagttctcagtccatacaataaggaagaaataaaattgcaaacatctgctgataaacacattttgaaatttaagagtccaaaataatctgtaggtaaggtacatgaaaataaatgagtttagcacagtcagtgaacaaaaataaattaaaatttatagctatcagcaacaaattattggaaaataaaattttaaaatgtcatgccaatgatat

SEQ ID NO: 260566 - DNA, 494 bp, Homo sapiens
ctgcatcttcgggtattcagtccccttctacactgaatcagtattagcctgtgtggccaataacttgtgaccacgtgacttaatgaaatgatgatttgtgtcttatgaggttggtcataaaaggcactgcagctctgaggaaagccagctggtggtatgtaaaggcactcaagcatccctgtggagaggcccacatggagaagacttcctagcaccaacttgacaacacatgtagaccacattgaaaataatttctcaatttcctctgggtgactgcagccccagatgacctctgactccaaccttgtgagaaagcttgatatataaccacccaaatgagccatttttgaactcctgaccaagaggaaccataaaaactgatcagattaatagtgttgttttaagccattaagcattgtagtgatctgttttacaccggtagagaagtaatatggggtataaagattaataaatgatgcctatacacttcttta

SEQ ID NO: 260567 - DNA, 146 bp, Homo sapiens
catcataaagacctatagtggttcaagtagaggggacatgggttccaactcttgatggaggaatggcaaagttctagcagaccatgtggaacaagagatattgttgtggccatctttggaaaataaagtctgccacatacatgaat

SEQ ID NO: 260568 - DNA, 233 bp, Homo sapiens
catgaaatgtctttcttggtacagaatttcataaaaacttttaatcttggacaatataaaaaaaaagaaatgtaatgggagatcaacaactacttccaccagatgactgaaatctattagaggccctcaataattaaaatagcagagtactagccaggcacggtggctcacgcctgtaatcccagcactttgggagaccaaggcaggtggatcacgaggtcaagagatcaata

SEQ ID NO: 260569 - DNA, 576 bp, Homo sapiens
ttagaactttgagatacttatcctttggtgttttcaatgcatccctaagcccctaacttaattacaagtgaaatgctaaagtaaactacggtttgcaatgaacgcggctcctaattttcttaattaaatcttatttacccaatttcgttgaatgaaggtttatgctaaagagtggctttttattttaatctaaaaaaattggcttcagaactgtattttatgcagacattggaaagttgagcaactgcctgctggaagtgttgagtgtagccagagataattcggacaaaaatcttcgttttgttaagtacaggcatttttggttagatttgatattccacaatgtcatgtttaatgtttattgaaaagaatcatgattatgtcaaaataacttagctttaatggtctgaaataggatttttcttaccaggactagcagaaggcctaagaggagagttttctttgttactgatgaacagtatggtgacagtctttgaattgtagcaatgggcttctggttatacaaaaaatgtttatatattttaagctctgtaattttaagttatggcctttaag

SEQ ID NO: 260570 - DNA, 622 bp, Homo sapiens
ggaagaaggccatgagccccagtttgtgagtggcctctagaagcctgccacacgcctccccacaagcatggaaataaaggaaaaattgtgagtcccttcaagagaaattgcaggtacttagttagccttgaggagtcagggagcaacctgagaagtaagaaggtaataatagcttaaaaaatagcccccaagtaagttaaagttacccgatgtttggctccttatagaaactgaacataccccttgacctatgtccctgagacgttctacagaaatacagatctccaccagttggaaaatgctgagccctgtcacataggcctcagacaagagggaacggaggccaggagtggtggcttatgcctataatcccagcactttgggaggctgaggctggtggatcacctgaggtcaggagtttgaaaccaggctgaccaacagagtaaaaccccatctccaccaaaaatacaaaattagctgggcgtggtggtggatacctataatcccagatactcaagaggctgaggcaggagaattgcttgtactcaggaggtggatattgcagtgagccaagatcgcaacattgcactccagcctgggcaacaagatggaaactctgtca

SEQ ID NO: 260571 - DNA, 415 bp, Homo sapiens
cgcagcgagctgcggggagtccactgcggccaggcttcgtggtgccggcgccgggtgaaggctgcgcgggccgccgcggggccgagggcttgagagccactggcttcaagccgcgagtggcagaggccaggcagccgcgggagtggattgcaggcgcggtgtgggaacgccggcaagtcccccgcacgcagtctctccagacagcctcggggattgaaggtgtggcctaaacaggttgcatttctcctgctggcatttcgggtactcctcccagccgcgacccgatgcaccctcgaactttctcccggagaaatctctacccatcctgtcttttaatatttttcaagaggtctcaatggcccatccccgccagctgcctcttcctcccacccactcggtgtcaggggcggccgcc

SEQ ID NO: 260572 - DNA, 665 bp, Homo sapiens
attctcctagagcatctttggaagcatgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggaacaggaggcacgtcctgtacccataaaaaccccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatcttca

SEQ ID NO: 260573 - DNA, 134 bp, Homo sapiens
caaatgtagtcaactgatccctgataaaggagcaaaagcacatagtggagaaaggattgtcttttcaacaaatcatgctggaaaaactagatattcacatgtaaaaaaaaaaaaaaaaagagtcctaacactga

SEQ ID NO: 260574 - DNA, 447 bp, Homo sapiens
gaaaattttaaatttttattgaaagaccttaaagaaaatctaaataaaaattggatgataatctatgatgctcgtggataaaaagacttaatgtcacagaagtgaaaacacaaatggaatacaaatatattttaaactactcaatgtttttagtagtcagagaaatgtaacataaaatcacaatgaaacaccattaaacctctaccatattaacagaaattaagaactcagacaataccaaatgttggaaaagatgtgtaacaatggaaactgtcatgtagttccagtgggaatgtaaattggtacagcggtttggtagtacatgaaaaagttgaacatgcacagaccataacccagtatttctactccatataatggaagctcttgtacatgtactcaggagacactgtacaaggatgttcatagtaacattgtttgtaactacaa

SEQ ID NO: 260575 - DNA, 444 bp, Homo sapiens
ttctataagggttgcattcagcaaatatgtagaattttaaagctggaagagacctttagcaagcccctgattttgtaggtgagagaacgaatgtgagatcaggtaactggtgatagttgcagatctgggactagaaaccaatgaagttatgctcagcatggttgctcgtgcctgtaatcccagcactttgggaggccaaagtgggaggatcacttgaggtcaggagtttgtgaccagcctggccaacatggtgaaaccccgtctctactaaaaatacaaaaattagctgggcatggtggtgggggcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaa

SEQ ID NO: 260576 - DNA, 1898 bp, Homo sapiens
gacagtctcactctgtacctaggctggagtgcagtggcacgatctcgatctcacctcattgcaacctccaccccctggcaaaatcagttatttggttatttggggcttgcaaatatattctatgaacagtccttttcaggatttgtatgatgctttataattttcaaagggtttctatattgtttctcatctgactccacagtagctctttgaaataggctgatcagtattattcctgttgtactgatgaaattataaagtatttagcctactgttgttgaaactggaaaggaagtctcttcacataaaattttatctctgccttcaaattatactccaagtataactaattctcactattttatcattttagttctggctaccaccttttcttagcttgaattctgcaagagccccctagtgttcccgagtccattttgctttgtatgattgtttccccacacagtagccagagtgatccagttaaaatgccagtcacctcacatctctctcaagctcacggccctccagtgactccctgtttcttagcaaatcttataatagatcctgtgtaatctggtgtctgggtattttttcagcctcttctactatcttccccttgtttgtgctactctctccatactggccctgcaggcagaagtttgttcctgtctcaggggctctgcacattatgtgcctttatgtttctcctactgtgctcactcacttcagtaatgtgtctgcttaagtgtcaccctctcacagggccttctctgcccttgctgaacactctgaaacagtcattctcatcattgtctttccttgcccctgcgtgttccttccttgtatgaaggtgacctgttatgatttacttatagtcattctgctataacatgacatgggcatttctgaaagtcacggtgctgtgcaacattgcaccagaccaatttatggggaaaatggagttaggagcacagtaaccaaaaacattgtcagtgacacattttaaaaagataggaacctaataaaaattgtaacttagttttacacgtataaaatggttaaagaataacaccgcaataaatggcactttaccttgaccaaaacctgacttcttgtgaaagtggccactcattggaagggttgcagttcatgaattactgtaaagtgatggatggaagatacctgatacgagacaaaaacttgtaacatcaaatgtggatggacctgactcataattcatgatgaactaagatagctattagatgtttgagctgtgtctgccttgtaaattcctgtgcagcttgatgtagctagtgtttctcacaggtgaaaatacacataagtgggaaatttgctggtttctgatagatcagtagccttcaaacaaatttgtctatttggaaacaaatgttatagcagaactgactgtattttagtttttgtttgcttgccttttgtggaatataagctccaccagaagaggaagtgagagttttaatgtttttatccaccttgtattcctgttacctggaatagtgccctgaaactttatagcatttaaactaaatggttagataaaaaaaatttggattgttataatttaaggggaatgaaattatagtattttggattagcattcctcaaacttgaatgtgtatactaagcacctggagatactatagtccagtaattctggggtgggtcccaaagatctgccttttaacaagatctcgggtgatacctacacttcactagagtaacaaggttctatagcagcaccgtccagtggaaatatgttggccacaaatgcaaaccatatgtgtacttttctagtagctttgcttaaaaactaaaaatgattcaattttagtatattttatttgacctaatatatc

SEQ ID NO: 260577 - DNA, 349 bp, Homo sapiens
ctggatacacaaatattgatccaatctggactaattagaaggtcagtcccaataacaaatcgaagtcagctgggcgtgatggctcactcctataatcccagcactttgggaggctgaggtgggcagatcatttgaagccagaagttcaagaccagcctgggcaacatagcaaaaccctgtctctactaaaaatacaaataattaggctgggtgtggtggctcatgcctgtaatcccaacagtttgggaggctgaggcaggtggtcacctgaggtcaggagtttgagaccagcctggccaacagggtgaaaccccgtgtctactaaaaacataaaaattagccaagcatg

SEQ ID NO: 260578 - DNA, 302 bp, Homo sapiens
tgtactctagtctgggcgagagcaagactctatctcaaaaaaaaaaaaaagtcacgccaggaattgaagctggtgcaggactagaactcagcccttctccatccctctctcatcacaaggtcccctagcaaaccagctgcaggagagacaggcagctctgagccatgtggtttgtgtgtatgtgctgctatgagaaatgtctgggggtctgcatgggccccaattacttcagggactggtgggtggcttctccaagccggagcccgtcaggccatttttagccctgggtgaccacagcccac

SEQ ID NO: 260579 - DNA, 238 bp, Homo sapiens
tatatatgcatttatgagtggatttttggtgttcctccttgtggatataaatttgtgttttccagactacacatgtatgatttttgtggttcatttggaaaaaggaaagatcccagggcatggtgcagtagatacttgcagttttgcaggcctgctttctggggtcaggaggtcatctgtctcttttgcatttagtttttaaatattgatattggtgatgcagccagggtgtgtagaa

SEQ ID NO: 260580 - DNA, 525 bp, Homo sapiens
gggatctaacacgcagaaatacacacgccaagacatgcaaagcggcccatggagcattgatccaaagtggaaggcaaagtggtctcccatccacggggaacattgtggttgcttgcacattctacatgcttaccactgctttcacacggccatgaggaggaatggactccagctcccggccgccccggagggagtggggtcagaagatgcagaagagggtgcatgatgaggctctgcttttaaaatgctgacagcttccagtgtgtcatgtacatttttgtgtatgtcaaataagcactgagaaaaacttagggaaaatattgtggattacagatgagacactcatattgagaaaggggcaaaccaagtacgtacaaaagaaaaagtctgagctaaacaatgtgtattatgtttgtaaaattacatttgtgtgattattgtgaagaaacaaaacttaaattttctttgcatttttcgagtaaacattatatttcatgtgtgatgagggtgcattccgtgtccgtt

SEQ ID NO: 260581 - DNA, 369 bp, Homo sapiens
aaaaaaaaaaaaaaaatcccacaaagaaaagcccaggctcagagccttcacgatagaatttttctaagcagttaaggaagaattaacaccaatccttcacagactctttccaagaatacagcaggtgggaacgcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggcgcggtggctcacacctgtaatcccag

SEQ ID NO: 260582 - DNA, 302 bp, Homo sapiens
acaaaacgcaaaaatttgttatttgagaggatcaacaaaattaagaaaccttaagtcaaactaaccgaaaaataaaaataaaaataaaacacgctcatattactaaaatcaggaatgaaagtgaggcttttaccatagagaaattgaaaagtatcttagagggaataacatgaacaattgtgtgtacaatttattgtatgctaataggaaacctagacaaatggacaagttcctagaaagatacaaacaattgaaattgactcaagaagaaacagaaaccttaacagacttatataacaagt

SEQ ID NO: 260583 - DNA, 299 bp, Homo sapiens
cggcacgaggcaaaattgcaattttccaaatcttccacaccgtacaccagaacttccatttttaaccagacacattactacctgaaagaaaggaccacatgccacagtttggtcatggtttattaactaaatcctaacaagtgttctgtgggacttccaagaagtcttcttaaaagtgcaagggtgaggtagaagtggggactggtgtcttcctcctccttcctaggaagaacatggtgtaagaagagaaaagagcaaaatattagggccctgagggacacaaagttgctgggtaacta

SEQ ID NO: 260584 - DNA, 364 bp, Homo sapiens
ctgactgaggtactgctgcttaatatggaagttcagatggggagagcagagggaaccaaaagaacccacgtcctagaggattttttctaaatgtcttgtgagcattttttccgcatttaaaagatttacttgtcggaattatttatgtgcaatatgattgtagaaagaaatcacctagaaagaaatcacagccaattcatttttcagcctctaaacacttggacagaggagccatatatgaatatgttcaaaagagttaaggccatctcctgtgggtatcagagaggcataattagaatgcattgaattctctccaactggtttgctgaagctcttatgtgagctttttcttttccttccttta

SEQ ID NO: 260585 - DNA, 1908 bp, Homo sapiens
atttcatttgttaaaaaaagtctcaactcattttactgagctctcccttttctagggcaagtatcatcgccatttgccaacatcaatatgaacttccagtttttaagagtagcttgtgaaaggttttagaaaaggaaacaaagatgggttttgaactttagattttcatgtcttttgtctgcagtgtatatttgttctcccctctccttctcctcctttccccccttgtctcccaaagctcaaacttgcttgagtctatcatagagactaaaccttgagcttcccctaaacttagctttaggaagctgagctgtggcctcacctgtctgccatgaacacagatttctctaagaaagccatattgatgagaagcccccaattactgcagcagacgtcgcacaatggtaccaaaaatgagcctctccagctgatacctggtagagtgagaggagccaggaggaataacttaggcctggaaattatctgcaggctttgcaatttgaaggttgagaaagagagcttaaatcaattagcgttctctcatgggactggtatgtttgtgtcaggatgaatggtttttggctctcctgttgcctcttggctaaaactctgattgagccaatggttgcagtctgatgctggacgccaacccaatttctgctaattattgcttttgtgattaaaagaaggtgggggtggggggctcccacagatgctgccaggtttgttttgtacaaactgaaagttaacttaattgtgagaacggagacctcatcactagctgcatgttttggatttgggggcatttacatttgtgttaattatgatttgtccaggtaagatgcagtagctgctccctgagcagctgtttccccccccaccccacttcactataatttccaagatttatttccctttgtttaaagggacacgcttaggtgaaaggttccaaatttacctggaaatggttaccttgtaaatttagcttgtctaatggattgtttccatgatattaaaatgtacagtcaattggaagaaaaaaaatgataaaaataaaatgaataacattgttagaaactggcacctgaaaacttcccttcaaagtgggggaaaaaaccgagtagctgaggaaagactttcattggttcactgtgtagaatggtggagcattttccacttgtgagattatttcataacaccaacaaatgccagaaactcattcagaaaaaaagccatatgtgaaaaacagtaatcctgtcatatccttagaggagaaaaaatgtatatttcttaacaagtggtgttgtgacttcttatgcaaatgtcttgcatattagtaacttttattatctttaggactgtgcttatcaggtacaaatgtgtctagttctgttttattgtttctttttcctttatatttatgtattgcatgaggtctgtggtcaatgcaaaatcatgatgacctcaatgtctttgaaatttgcaatgtgtttttaatatgtaagaaatgtaatcaacttgtatttcagtaagcagcactttaaaaagagtttaacatgatgacctttaaatggataggacttgggttgtttttatggtaatgttgcattggagttgagttttcctttaattaagttcttgtttcctcatctatgtgtctctcagtgcttcctgtccacctttgctctcagcatggtttcccatgcctaaaagtaagattttcttttctctttgttcccttggctgtaggtcattgtcctcttcccagaggctagcacaataactgttgctcaatgtaagatgagatggcaagatcatactactgttgttgcacctggatttgagttgggacatgcttctttgaggcagatgattcaagagaggacgtgctgtgtggcaggtgttttg

SEQ ID NO: 260586 - DNA, 1037 bp, Homo sapiens
atttcatttgttaaaaaaagtctcaactcattttactgagctctcccttttctagggcaagtatcatcgccatttgccaacatcaatatgaacttccagtttttaagagtagcttgtgaaaggttttagaaaaggaaacaaagatgggttttgaactttagattttcatgtcttttgtctgcagtgtatatttgttctcccctctccttctcctcctttccccccttgtctcccaaagctcaaacttgcttgagtctatcatagagactaaaccttgagcttcccctaaacttagctttaggaagctgagctgtggcctcacctgtctgccatgaacacagatttctctaagaaagccatattgatgagaagcccccaattactgcagcagacgtcgcacaatggtaccaaaaatgagcctctccagctgatacctggtagagtgagaggagccaggaggaataacttaggcctggaaattatctgcaggctttgcaatttgaaggttgagaaagagagcttaaatcaattagcgttctctcatgggactggtatgtttgtgtcaggatgaatggtttttggctctcctgttgcctcttggctaaaactctgattgagccaatggttgcagtctgatgctggacgccaacccaatttctgctaattattgcttttgtgattaaaagaaggtgggggtggggggctcccacagatgctgccaggtttgttttgtacaaactgaaagttaacttaattgtgagaacggagacctcatcactagctgcatgttttggatttgggggcatttacatttgtgttaattatgatttgtccaggtaagatgcagtagctgctccctgagcagctgtttccccccccaccccacttcactataatttccaagatttatttccctttgtttaaagggacacgcttaggtgaaaggttccaaatttacctggaaatggttaccttgtaaatttagcttgtctaatggattgtttccatgatattaaaatgtacagtcaattggaaga

SEQ ID NO: 260587 - DNA, 997 bp, Homo sapiens
atttcatttgttaaaaaaagtctcaactcattttactgagctctcccttttctagggcaagtatcatcgccatttgccaacatcaatatgaacttccagtttttaagagtagcttgtgaaaggttttagaaaaggaaacaaagatgggttttgaactttagattttcatgtcttttgtctgcagtgtatatttgttctcccctctccttctcctcctttccccccttgtctcccaaagctcaaacttgcttgagtctatcatagagactaaaccttgagcttcccctaaacttagctttaggaagctgagctgtggcctcacctgtctgccatgaacacagatttctctaagaaagccatattgatgagaagcccccaattactgcagcagacgtcgcacaatggtaccaaaaatgagcctctccagctgatacctggtagagtgagaggagccaggaggaataacttaggcctggaaattatctgcaggctttgcaatttgaaggttgagaaagagagcttaaatcaattagcgttctctcatgggactggtatgtttgtgtcaggatgaatggtttttggctctcctgttgcctcttggctaaaactctgattgagccaatggttgcagtctgatgctggacgccaacccaatttctgctaattattgcttttgtgattaaaagaaggtgggggtggggggctcccacagatgctgccaggtttgttttgtacaaactgaaagttaacttaattgtgagaacggagacctcatcactagctgcatgttttggatttgggggcatttacatttgtgttaattatgatttgtccaggtaagatgcagtagctgctccctgagcagctgtttccccccccaccccacttcactataatttccaagatttatttccctttgtttaaagggacacgcttaggtgaaagcttgtctaatggattgtttccatgatattaaaatgtacagtcaattggaaga

SEQ ID NO: 260588 - DNA, 312 bp, Homo sapiens
catcacctccagtgtgccatcctggcaaacttctactcttccttcaagtttcaactcaaatgctacctccccttagaaacttttctgaacttccttctgctatagtcaaactggacattgcgtttaaaatgaatatcactttaacaaaaatcacatcaccactgtttgcttttctgtcttcagctggacctcaacagggtccttaaaggcatgccctatgaaaaagcttgggtctgtccagctttgcatccatggagtctgtggcaaaagactaggagtttaataaacttggatgacttggtctaagtagct

SEQ ID NO: 260589 - DNA, 432 bp, Homo sapiens
gaagaacctggagtccattgttctagagcaagaagcatccagtataagagaaagatgtaggctggaaggctatgccagtctctcttttcacatttttctgcctgcttatattctagccatgctggcagctgattagattgtgtctacctagatcaagggtgggacctcctttcctagcccactgactcaaatgttaatctcccttggcaacaacctcacagacacacccagtatcaatactttgtatccttcaatccaatcaagttgacactcagtattaaccatcactgcaacatgtaagtagggtcaggtcaataagatggatatgaaagttcaaacacaatgacaaatacactgtggacactcaatatatggtaggtattatgattatggtgatattttcaaaacctttactaatttttgtatacattt

SEQ ID NO: 260590 - DNA, 428 bp, Homo sapiens
cccggtctcagtacttttttgtttatgtctaagtcagttccaggaaggctgccaccatttgctaccaaaacaatccttacacaacaatagcaagtctccttccatctcctctattctggtccttgaaaccttatcaatggtgaggtcacagtcattgtttgttgttcggttgagaactgagggggtggggtaggaggaagaaggtctatttttaaaaatcacacacactaaaaaaggttcaggctctgagaacctgtgaaatcttgactaattttggctttccccatgggaacccaccagaaaagtattcaaacttgtatagaacacccttgacgtaactaactccatcttagaaaaatactccattttatatttcatacagcactttgccaattaggataagatgttttgcttaagaaacaaattta

SEQ ID NO: 260591 - DNA, 235 bp, Homo sapiens
ccagctatccccagtgccacctatggctgagagggtaccaggatgaggccacatctggggaccatatggggagtggggggtgcagggggttgggaggaatgaaatcgaagtggggactgtaagtgcagacaagtttagttgtagaaaagggaggtgaccgctggaggggagcctgtgctgtttggaggagttcagagcaccttgagctgggcaacaagagcaaaactccatctca

SEQ ID NO: 260592 - DNA, 270 bp, Homo sapiens
cggcacgaggcaaaaataaaaaagcatagaagatatgtagtgaaaagtttgattccacccgtgccccatctgatcatttttacccccatactcacccagaagtaaccacttgcataagtttgctgttgttgttgtcttagagttttatttctatattcatgtttacctcctttttaaataaaaagaagggtagcatgctactacacactgtcctccaccttgctttttccaaatgacagtgtaatcttggagaaagcaagttggcggccg

SEQ ID NO: 260593 - DNA, 241 bp, Homo sapiens
aatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagc

SEQ ID NO: 260594 - DNA, 465 bp, Homo sapiens
aaggatgctgaggcctggaaaccttggtctcacctggagatgtggctccacgatgcccttgggagcgagcgagtcatttcacaaagtgttaggagggaaaggagcctttctggggccagcacggttggaagagttcacagcctttctgtgagttgctttaggggcctaagactttggttgctgaaggaagtataaatgtacagtgaccctccaagagcctccctctcacaggtatgccccactttaagaaaacccgctagacgaaaaccctgacttttggagtaagatttgtcaaggagagagagttcttcccagtaccaaaggtttcagaaaaagacccgtttaagtagtaagctgaccttctgaaccaataaataagacagtggtttctttcttttgtagaggtcacctgttgtaaatctgagaacatttgaagaatttactgcattggctcattaaggttaa

SEQ ID NO: 260595 - DNA, 320 bp, Homo sapiens
tggggggagggggagaggcttattagcttagaaaaattcccttagtgattttgatgccctcctcaccccgccactgagtgctactgatttattttagaaatgctctcccacagatgtctgcatgactgactcccttatttcctcagcttccactcagatgtcaccttaccaaagagatttcgcttgatgatcctagcccactttctgtctcctgaccctaatttatttttcttcatggcactaaatatcatctagcacattatgtttctattgtgcgttatctgtcttccccaaatgctcaataaatgtttgttgactga

SEQ ID NO: 260596 - DNA, 573 bp, Homo sapiens
ttagttataaatcaagcctgaggtttcagatttctggactaaaaatatggttcagtttgtgctgctgtgggatgaagaatgggcagagaaaatccacagtgcaggcatggggataaatggcatttggcacttagctgcagggtttgggggacaacagggagtggtgggatggtggttaagtaagggtgcatgccccacctgaagctctacagtggctcagctccaactgagtgttgccatgggaaaatctgatggggccagatctgatccttcagagaatgaggaattccaggttgttatgtgaattctcacaatttgtaaatgtcggcttgccattcagcttttttgtttgtttgttttaaataatatcatgtgggtcaaacaaactatgttaatggtagccatctggcctggggctagtagcttattgcctctggccagtggtgtgctaacaaaagtttaaccagcagctctccaacaaaaaagggaggtgggctgctctgcctatgcagtagccatgcttttattcctttactttgttaataaacttgctttcactttaaaaaaaaaaaa

SEQ ID NO: 260597 - DNA, 271 bp, Homo sapiens
cttataccacacttagtggtacaaggtataattgctacatcaacaacgtttacccccaaattaagtcacaattaatattcagcagacttcagtaaatatcacctctcaccctttaatttgtattgttcagcatgacagactactgcttgtttttaagaaaaatacaactgatttcttaattccttctggcctttgataactttaaaacaaaacatttcttaaaaagtctgagtatttgacatcaaaaagcttaggatacttacattttaaa

SEQ ID NO: 260598 - DNA, 608 bp, Homo sapiens
aaatggttgtgatggaattcagcaacaccaataccttggtatttctgactttcaggatgttaggagactctttcagtccttcctgtttaaatatgaatggatatgtattgccattattgccctgcccctacatctcccaaatttagattgctagtatttatgtaagtttactagtcacaaatagattcttgcatttcccatctcttgtcatagggccctctttgagttcaatatgcttttattggcacttactttggttttctttacagcagcagctgctaattagtgacagcttttgagcaagcagcttgtcatttttggcagagataggggacatccatagcaagtcaagactatattttcatttgctaaatttactttgctacatggaaatacatcttggataaaaaatagtctgtagtcaaaggtggctgtgtttactgaattatcttcctgagttggcattctgtcctgtagttgaagaactcacagagatgaaaaaaagaaagaaagaaagaaagaaagaaagaaaggttcaacgtctatcagactgatgccataagtcctgagtcatccttctaacattaatctacattctatggctgtca

SEQ ID NO: 260599 - DNA, 521 bp, Homo sapiens
ctttataacttcatgaacagacttagaagacatttacttctcagctttagaataaaggaggtattctcagttgggtctctatagaccctagatttgctgaaaagcattaaatgggtagaaactaggtgctctagggaactgccaaatatatttcctaagacagaactgggatggagaattttttgcgttacagcctggagtaaattagaaggcagctggaaagccccaagcggctttcgagttgcacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccttttttgctgtaactttttaaaagttttgactttaaaaagtttacaaatcgtaattagaagcgctctctatttttttttttttttaattaaagacaaggcaactcgaaagccccaagcggggtaccgagctc

SEQ ID NO: 260600 - DNA, 558 bp, Homo sapiens
gccattatcttagaaagcagccctccaggttcaggggtaactccctttcctctgctagactaaaggggcccacagctgttttcttaaggttcagctttctgagattccttctacccagtattacgtgccagcatccactgatcaataccagatgcacctattaattgaaaattgttggcatggacaggtgataggtagtagagactacaagaattacctgcatttccttccatactttgatttacttaacactttttttttcccaagagacacagggattctctctgttgcccaggctggagtacagtggcatgatcatagctcactggagcctccagctcctgggctcaagcaatccccccgcctcagcctcccgagtagctgggactacaggtgcgcaccaccatgcctggctaatttaaatttttattgttgttgttgttactgtgtggcccaggctggtctcgaactcctgggttcaattggtccccccgaagtgctgggatttgggagaatcgctaagggggctaccatgcctggccttatttaacacttttg

SEQ ID NO: 260601 - DNA, 543 bp, Homo sapiens
tctgtatccaggaaaagcccaacctttctatactaaggccagagaggttcagctccttaaaatattcatgaaaatccgaaagttattcccagttatttccaaaggttcctttcccttgagaaggcagcatgggcttatgcctagacccacacctaataataatgaggtatatttggtagacatagactatatttggtagttagggctggggtgtgggttattagaaaggatcttaaatgaaaggttggcatccatcaatttagtaccatagcctagggtctatcccctgcttgcagcattcagccatattatctcagaggtcttagccactgtgtgaattcctctagtggcaggcgctcaccacctcagtcacctattaaccatcctgaagtaggtggtcattcctgaaggtgagttgaaatctgactttcttagcttctggtcttcacttttggttctatcccctcaggtgtcacagaacaaatccagtttctcacttgaggcagcctttttactaagatgctacctggcaggtgtaagcat

SEQ ID NO: 260602 - DNA, 285 bp, Homo sapiens
agttacaaagctaaaatcaatatgctaagtattctaaatagagctacaaacatatcctgtgggacataagaagaaaagctgcacttggtggtttgagtatcatctctcctgacatacctcgagcctgtgtaaaaaagaaaagttactttgaaaggaatttgtaggactaaatttccttttggattttctcttctcccaagagaaggaggtatgtgctctgctcttcccaaatcaaggaatgtagatcttgctaacagaactgctcaaagacatggggtgcttgca

SEQ ID NO: 260603 - DNA, 408 bp, Homo sapiens
agggaccctgagtactgcctctgacctctctatggcaagccaaatggccatgggaagaccccatggagtgtcagaatgatgccgttgagggcaaggattttagaccggtcatggattctgcctgtgcactgggctctaccactttctagctatctggctactagcaagttaccttaacaatctaagtttcaacctccccattcgtgaaatggagatgatgtcttagtcatagaagtagcaagtctactgcatatcaacagtgtagcactgagcctggctctttataaggaaacaggccgagagacgcaagtcaaacagcaaaggatggtctgctgtctgtctgactccaatgccaatggtctttcctctataacctaaagcaataaaacccctgcaacatctaaaaaa

SEQ ID NO: 260604 - DNA, 486 bp, Homo sapiens
agggaccctgagtactgcctctgacctctctatggcaagccaaatggccatgggaagaccccatggagtgtcagaatgatgccgttgagggcaaggattttagaccggtcatggattctgcctgtgcactgggctctaccactttctagctatctggctactagcaagttaccttaacaatctaagtttcaacctccccattcgtgaaatggagatgatgtcttagtcatagaagtagcaagtctactgcatatcaacagtgtagcactgagcctggctctttgctggagcgcagtgggatgatctctgctcactgcagcctctgccttctgggttcaagtgattctcctgcctcagccgcataaggaaacaggccgagagacgcaagtcaaacagcaaaggatggtctgctgtctgtctgactccaatgccaatggtctttcctctataacctaaagcaataaaacccctgcaacatctaaaaaa

SEQ ID NO: 260605 - DNA, 353 bp, Homo sapiens
taatgattgccagtttttaatatatcctgtaagaattattttatgcatattaaaagatttttaaaagcccgaataatagaggatactatacagttctgagccttgtttttatgtaattgctttttgagatcattctcatgagtacttcttcagttgccttattctttttcatagttacatagtatattccaacttacaccaatactgtaagttattcagtcagctccctgaaaagataacatgtacattgtttccaagctgctattattaaaacaatgttacattaaatccttgtatccatttcccagtatgtgtgtaggataacttcctaaaggtaaagctgcttgatcaaa

SEQ ID NO: 260606 - DNA, 471 bp, Homo sapiens
actagtctccaagacccattccagttaacacttctttcagtagttttacaatactttttgctcaattatgtgaagtgtgacagattttaaattttattcagtgacatagctctgaagtctttatttcaaactttgaagcagttattaatatggaaaagtgaaattctataaaatcctgtttctctgatttttcattgatttttgctggcaggcaatagcgtgtttatcagaatgtttgttcctagaagagtactgtagttataaagttaaaggcatttactgcagtaagattttattctagctgtacgtgtactagtgatcaaagctattaaaactttgtgttagaatgtatgtcggaatatcaaagcagcagcagcagcaggaggaggcattgcagctgttttaagttttggctgaagtcagattttgaagcctgaatattttatgttaagataaaagaaaaaagaaaaa

SEQ ID NO: 260607 - DNA, 238 bp, Homo sapiens
ttcccttttctcagctcttaattccattctgtttttccaacagaattttgtctcaataattgtctgttttttcacttgaaatgtttttgattatcctatcgtatttctctgcagcaaaaatgtgtatatatttttcaatttaaatgctctttaaatgttcctctgattataaggctctaagtgttgtttaaaaatttgctcttgtttgaattatcatgacaattagtattagaataaa

SEQ ID NO: 260608 - DNA, 529 bp, Homo sapiens
aggccaggaacagagagcatgggcttccccaaggctctctccacatcctccttctctttccctctcaaggaaggaagacctgacttatttacacaaaactaaacacaaagatctgtaagatctgagcaaaggagaaaaagatccccacaaagaggctttgctgggggaaattacctaggtgtttgctaagccattgcccaggccagaaagaaaacctgctacaggcatgtgcctgctggttgtatattagaaccaagcacacagcttggtaaggaactcagtggggcctttctgggccctttctatgtattaggtaaccctgccctgatattcgtctcagccccttgtactcttctacagctcactgtagcaccctggtgggcccatgcagcctggcagttctgagaagctgaggcttgcacaccctccatatggaaggacaaatcggcagataagaggagggtggggtacagcatggcgccccagcagcagtttggagcctgggttttcgtccctgaccctcaccaac

SEQ ID NO: 260609 - DNA, 474 bp, Homo sapiens
tactcttcagaaaccccttaaaatagccccccaacaccttcatatagtaatttcctgacatgtctccctgtgtatattctcagagcatttatcacaattggaaattatcttcttaacctatttacctctttcttgttgttatccttaaccctaccatttgtgtgtagctctttgaaggcccagatcatcctcattactggctctagagcttcacatgggaccaggcacctagtggggcctcactatggattcaatgaatcaatagataaaagaatgaaactcctacaaaaattcagtacatctaggatgaagcaggacagccagaaactgagcttggattcagaaactttaaattaaacattcattctgggccaggtacagcggctcacagctataatcccagcacttagggaggccgaggcaggagcctaggagttcaagaccaggcaacatagtgagaccttgtctctacaa

SEQ ID NO: 260610 - DNA, 359 bp, Homo sapiens
tgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatataaaggcttctttcaaaagctgctagaattaccttctgtttatctaaaaccttataattctgtacccaggtatattacctttagggattgagggcacaatgaaacatttttag

SEQ ID NO: 260611 - DNA, 443 bp, Homo sapiens
cccaaacctgtaatcggcaccccagtgagcagactggacatccccacccccacagctgccctttctcccctccactcatgttccctctagggccaccacgatcccgacttgtatcaccacagatgagtttcacatgtttttgaattttacatcttatctgttttctgttcctatacaagtttgccttttttgaattccatataagtgggattctacaatgtgttatctcaatttgagtctgttttttttttcctgctcagcatgatgtttttgagatgcatatatgcggttttgtgtatctgtagatggttcttttttattgcagaataatgttccagggtatggatgtaccaaagcttgttcatccattcaccagctgagggatatttggactgtttccagttttcagccattataaataaagccactagaaacatttgcaa

SEQ ID NO: 260612 - DNA, 284 bp, Homo sapiens
ctggattcagctttgagtagctagaggagagaaaagtcacaaatttttacctttcctggtcatgcttttgctcacgctgcgctcaggaaaatgtaggcctatgcctgtctagatgtagcatcagccaaagccaagcaaagctgcaagagctgcagatgggtgaactcactcatgcggtttgcctgggcaaccacaggactgacattgagacattttcctttcaaatgagactgtgataactttcactgaccaaaacatctgggaaaaaggtttggtttaaagca

SEQ ID NO: 260613 - DNA, 410 bp, Homo sapiens
cagtcctagctaatgaacgtgtgagcatgatgcaaaaatgtatgctcatgatatgaaaggagaggcttagggagacagaaacgttgagatacagagtaaacgataccaccgcgagggggaaaaaacgcgtttaattacattttagacttttcaatgataacacctgtattttgtgttttattactcatgtgattttataatttgagctgggtcaatacaaacaaaaaggtactgtcagtttatgctgacgtaatgaactgcgatttcagattccttggtctgcgtgcttgttttctcctttgcccaagttcccagattctcaaaactctgagattagttttgaagggatgagacaagaaaacatataaatactccagaggattaaaatccaaaagcatttaaagttgtat

SEQ ID NO: 260614 - DNA, 443 bp, Homo sapiens
agggtgaacacttaggtggacacatggatattgatgtcagtgctgcacagggcacggtactggacaagtgtcacaagtccagctgggcaaactccaggatgccaggtcacaagggctgtttccaggaagggctgacccctgatgtttacatccttttcctctgaagctcagtggagctcaccagtctcagttcaccttgtaggccactgaagaaattcccaattagcacagaggaacgtccaaccctatgggatttgagactggagattgcagccatcacatgatggaagcagaattagactccaaaaaccttgccttgagtctcggcgtctcggctctgtcatttgccagccaaatgaggccaggcaagtcacaatctcatggagtattcacttatctacctgtaaagtaggaatgtctgacctatttcagaagattgttct

SEQ ID NO: 260615 - DNA, 418 bp, Homo sapiens
gaattctgtcaatctctaatgccacaaacttctgtgaagcctctcctgtgtgccaagcactgggcttgaggtgaggtggatcccaagaggaaaggtgcagacagtcgcttcccatcaaggggcagagagcagacctggtgcagtcactgtgtctcagaggcgctgcttgaggtaacatctttgcagtatcttctgatggaggatataggaactgattactgatataggataaaaggcaaataggttgggactatatttcactgttgtcattgttccttactctttattcagaaggtgctttctcgtgacaagtttaaatagtgaatgaagatcagatatttcaacagtaactgaaataacctgttcataatgaagtgaactgtttggccagcagttaaataagtgcggctttttcctt

SEQ ID NO: 260616 - DNA, 311 bp, Homo sapiens
caggagttcacgtaacaaggaatggcagaaacgaaggatgtttttggccaggaaccgcatccaggtaacatctttgcagtatcttctgatggaggatataggaactgattactgatataggataaaaggcaaataggttgggactatatttcactgttgtcattgttccttactctttattcagaaggtgctttctcgtgacaagtttaaatagtgaatgaagatcagatatttcaacagtaactgaaataacctgttcataatgaagtgaactgtttggccagcagttaaataagtgcggctttttcctt

SEQ ID NO: 260617 - DNA, 400 bp, Homo sapiens
atatataaaggggagtttactaagtattaacttacatgatcacaaggtccctcaataggctgtctgcaagctgagcaaggaaagccagactgaatccccaaactgaagaatttggagtccagtgtcgaagggcaggaagcatccagcacaggagaaagatgtaggctggaaggctagccagtctctccatttcatgtttttctgcctgctttgtattcattgacagctgattagattgtgcccaccagattaaaggtggatctgccttctccagcccattttctgcctgctttgtattcattgatagctgattagattgtgcacaccagattaaaggtggatctgccttccccagcccactgactcaaatgttaatctcttttggcaacaccctaacaga

SEQ ID NO: 260618 - DNA, 186 bp, Homo sapiens
gaaatacacgccacatagagggaacagttttgagtcacaaattgaagtgatggctcccagttttttcccttggaaggagtacctggacacactgctgttttaagtatcaagagttcttcagaatatttgtatttgtgccctttgtgggcccaggaagtgcaagcagaaggttgcctgacttcgtag

SEQ ID NO: 260619 - DNA, 408 bp, Homo sapiens
gcaaataaatattagacacactgtttccttttaaagtgttcttatctttgtgtttcaggttgaatcatttctatagacctgagttcatagtcacgagttcttttttctagcatgtacactctgctactaagcaaaacaagtgaattcttaacttctgatattgtatttttaatttttagatttttttcatgtgctctttaaaaatactttccatttctctagtgaaattccctatatgttcaccatgttctcagcttttccctttcatcttgccaacatatttcccattctcagtttgaatacctgatcatttctacctggtcattattctttctgtgggtgttcttctgatgactgtttttacctggattaagttaccttttcttcttcacttgtcttgcaattaaa

SEQ ID NO: 260620 - DNA, 384 bp, Homo sapiens
ctatgttgaagagtaaaatacttagtaatatatagtacaatatttagtaagttactgactagtttgtcattgtaatcaaagagtttgaatgatttctacacctcctcaggtgctaggatttatctttaagcaccttaatatatatacatagtatataccatcatcttcaaattaaaagttatcagcttttaattttttccagtacaactacatataatgggtggatatataatagtggaaacttcacatgttgttcttgatcttacaaaagtatgataagaatcttgggcataaaagtggaactttagcagttcattggaaaagaaagccacaaattgatctttagcaccctatacttttcctatattaaaaacaattataaag

SEQ ID NO: 260621 - DNA, 449 bp, Homo sapiens
tagtagtcattctaataggcatgaagtgatatctcattgtggttttaatttgcatttccctgatgatttgtgatgttgaatatttttttcatatacctactagccatttgtatgtcttcatttgagaaattctattcaagtcgtctgaccagtttttaattaggttatttgctttcttactattgagttgtttcaattccttatatattttggatattaaccccttgtcagatgtttggtttgcaaatatattttctcattctgcaggttgtctccttactctgttcattatttttgtagttatgcagaagctttgtagtttgatgtaatcccagttgtccaattttgcttttgttgcttgtcatttggggacatacccataattgatcttagccaaaaggctgagaagtgatttgggtcatattaaaaaatatcattgccaagaccaa

SEQ ID NO: 260622 - DNA, 208 bp, Homo sapiens
catggctgcctagattctagacatcctatttcctatgcccaggccctctttccaatgtgttccattcacgttctgctaaatagaaaactgtgtataatccttcctcttttgtcctcccaacactcacatcttccaaatcaaaacccaggagtcaactctgtatgatctctgcaacttttctataaatctaaaattattacttttaaaa

SEQ ID NO: 260623 - DNA, 345 bp, Homo sapiens
ttttttttttcataaagcctttcttcagggtgaagtttctttgtttttaaatctaggactttaaactcaaataaccaaacatttaaaaatctattatgcattatgatatgactattttagaaaaaacttcaccagaatcttctctttcttaaaaaatagaaataattaaaacaaaaagcccttaaaacgtgaatattcttagtatttccgcaatatgtacttataaaacaaacattagtgaaaatcaactgacactatcaaagagaagagctttaataagcacttcccaatatacctataaatgcacaatataaaactaaacagttaccatgtacctttttaatt

SEQ ID NO: 260624 - DNA, 472 bp, Homo sapiens
ttgaattctagggtttgtggtgtgcataattacttttacttaagagtgagattggcagatagctgtataccagagagtttttgaatgctgttggaaggtaagcgtggatttaattcatgcaaaacaaaccgttgaggagctattcaactggcaacttttgtctcaagtaataaagtgatttcattttgactgacagataatttttcaatataagagtataaagatagctgcattatatttgttctaggtttttgacaccaattttgttggtgtttagaagaatggcaattttatttctacctcctggacaatggcacgtgaacactcattcattcaccgagtatttgttgagcatggctgtgtgccaaactctgtttaaggggcataaaatagagcagttagggagagggaagaaattcctggcctcagagcttccatttcagttgggggagaaaataatgaataaataagt

SEQ ID NO: 260625 - DNA, 430 bp, Homo sapiens
attcacttccagagagcaaaatatctccatgatttctgtattattggtgaagccacctcaaagcccctaataaataaaataattacctttattattattatggtcacattatagctaggtaaggacttatattcttgatcttagctacctgtgtaacacaagacctgcttaaagataaaaatttgcttgatgtcatgattgattaaaatattgttaattgggcaaattgatattattcagcctcaagggatagtaatacaatatttcatgtttaatacatttaataaaatggtattttgtctataagaatcactagcctttccatttttaaaaactacttaaatctcaactccctgttgacattttgcttttattgcaggaataatggtaaagagaaagactagatccatgttagcaaactgatacactt

SEQ ID NO: 260626 - DNA, 5240 bp, Homo sapiens
  misc_feature (59)..(59): n is a, c, g, or t
ccggcacccggagctcctgggcacacgcattggcaggggccgcttcggcagagtgatgnctgatgatgagtccgagagcgtcctctccgactcccatgaagggtcggagctggagctgcctgttatccagctgtgcgggctggtggaggagctcagctatgtaaactctgctctcaaaactgagactgagatgtttgagaaatattacgctaaactggagcccagggatcagcgacctccacgattatcagaaattaaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgacgcaaggaatcaagaattgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaattttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcccgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgactttt

SEQ ID NO: 260627 - DNA, 5034 bp, Homo sapiens
ggcagtgaatcgagctcggtcccatctcgtgacggcgattatcacgaaattaaatatcagcagcagattatgcacagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgacgcaaggaatcaagaattgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaattttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcccgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgactttt

SEQ ID NO: 260628 - DNA, 5113 bp, Homo sapiens
  misc_feature (59)..(59): n is a, c, g, or t
ccggcacccggagctcctgggcacacgcattggcaggggccgcttcggcagagtgatgnctgatgatgagtccgagagcgtcctctccgactcccatgaagggtcggagctggagctgcctgttatccagctgtgcgggctggtggaggagctcagtttcgaggcaggcgtagatccaaatcccggacaggtatggaccgtggggtaggcctgactgccgaccaaaaacttgagctggtacaaaaagaggttgcggacatgaaggatgacttacgacacacaagggcaaatgcggaacgcgacctgcagcatcacgaggcgatcattgaggaggctgaaattcgatggagtgaagtttcgagagaagtgcatgagtttgaaaaagatattctaaaagccatatccaagaagaaagggagtattttggccactcagaaagtgatgaaatacattgaggacatgaaccgccggagggataatatgaaggagaattacgtttgaaaaatgtttctctcaaagttcagaggaaaaaaatgcttttacaattgaggcagaaggaagaggtgagtgaggcccttcacgatgttgattttcagcagttgaagatagagaacgctcaatttcttgagacaattgacgcaaggaatcaagaattgacccagctaaagctgtcatctggaaacactctgcaggttctcaatgcctacaaaagcaagcttcacaaggcaatggaaatatacctcaatctggacaaggagatcttgctgagaaaagagctacttgaaaaaattgaaaaagaaacactacaagtagaggaggaccgggccaaagccgaggcagtgaataagaggctccggaagcagctggccgagttccgggcaccacaggtgatgacttacgtccgggagaagatcttaaatgcggacctggagaagagcatcaggatgtgggaaaggaaagtggagatagcagagatgtccttaaaaggccatcgtaaggcttggaatcgaatgaaaataaccaatgagcagttgcaggcagattaccttgctgggaagtagccagaggcaggccacggcttacagaccactacatgacctataaaagtaatcagctcctttctagtcacgggctcctctcactgttccctgtctgcctggtgttcccaaccccccacccaggctgagtatcatctcctgggccacatctgcccatggggagtgttttcacagcctggcccctggaactgttaccactgaaagaaccacagggcactctaatggtttgacacttgttagccagcatttagttcacaagcatagtgaaagtgaccttcccacacctgggagagggatagaggagggagagccagcccagtgtatgccatgggcttatccgtggcagccccagtgtgcaactatcaaaaacagacatcaaaacagcatggtgaatgcctggcactcagcattctcagtttactcttcagtttggtggggtagctcctggactagatactgctgcaaaagaaaacaagcacgaaggaaaccaagatgatttcttcgggctgatacaacctgttctgacctgcaaaaatcctaccttcccccacctccccaccgtaatagtcatagtataagggttgtacagacgcctcaggagacctgcctgattcctttacatccttctccctaacatctagactatctctagagctgtttcctagtcgtgaatgcgtgatggtccttctttgtccctgcaagtatgatccaacatggcccagttcagaatcagaatatgtcttctgtgtcatggtggcatttggtccatggtgggagaaagaaatcaacttttcccagtggtggagtgaggacaggggagggccggccctctcagccttggatgtgatccatttgctgtagtcttccaccttggtgtacagaaacaggccagggcacgtctcaccaccgaagttcaggactcctctcagaacccacagatcgaactgctgtagctggcacatcattgggcttcctgggtccccctgtgataaaagacagaaggcttcaagtcttagaaaaactagtttttgttgtaaatctatccttgtgcaatatactgtttgttctagaaatgttttacgctggttctcactggaaatggggcaaattataggatacaatttcaaatctaggcagccaccaccacaaattccaacaagatgacttttccttttattatgcaaattagctgtggacttctgctgattgcctatagcttcctggttcatatttcattttcttgcccctttccagtcctttggccaaaccttccctctcttctggcttctcattcctgaaatgttggtgtttgtttctgttttgtcctgaaatgctcacattttcccttctctgccttgcttcaacccttagtgtaagccacttcctgccacctggcaactgcttaccagcctggctggccgtgctctgggtcttccctactcccaatggagcagtcctctgggacttgggaattctgccacatacactttatctaacttaaagtgacggagtagaagcttggcatcattagctagatatgggaccctggcaagtgaccaaatcctctctgagccaaggtgggaacacagttaatgcctgtaacacgtgctgagcacagcacagtgcctggcacacagcaaacactcaatagaatattagctaccatcatcctgatgtcgctataaaggccagcatttttctgaaaagttggggaaaatgggaaaagcaacaaggcaactagtaggtatcacttaccttacctgcccagaccccacacccctaggtctcctctcaaaggaattcctgcccctcccatggcccatcttggtccgagaagggggtggtcatccccaggctagccagccacttctgacctgtgtggcctgcctggctggaaggcccaggcaatgacatgttgctctcgcagtttggactgagacatggaatggggccgcaattaacaacaggaaacaatctgaacagactgaaccacgagcagcagaaaggcagaagagcagccgcttcagccccttaccatccgagacctgggtgtgtggtctgtcttggtcactctctctgtctctctttctctctttctttctctgtccccaaggctggagtgcagtggtgcaatcttggctcactgcaacctccacctctgggattcaagcaattctcccacctcagcctctcgagtagctggggctacagctatgcgccaccatgcccagctaattttttttttttttttttgagatggagtcttgctctgtcccccatgctggagtgcagtggcatgatctcggctcgctgcaacctcctcctcctgggttcaagcgattctcctacctcagcctccccagtagctgggattacaggcgcccaccaccacacctggctaatttttatttttagtagagatggggtttcaccatgttggccaggctggtctcgaactcctgacctcatgatccacccgcctcggcctccccaagtgttgggattacaggcgtgagccactgcacccggcctaatttctgtatttttagtagagatggggtttcacgatgttggccaggctggtcttaatctaacttcaagtgatctgcccgcctcgccctctcaaagtgctgggattaggcatgaactaccatgcccagtggggtattctctttcaataaagctcctcttttccaaggaagccacaccagaacagagatgaagaccagtgggaaaacatgggagcaactccgtgggcaggccagcggggaggccatgctgcaaagctgccgtgattccctggtgatctctcagcaggccaaggccagacatgtgaggaaggccttgaggacttcattctgtgcctctccttggatggaagggggtgctttagtgtggcactcctgacttttcaattgactggtgaagaggcccttgtgtgcacctcactatgtctgcctaggtcatgggggctccctggccaagaatgacgtggttccccctttcatcagtccgattcgcagtttgtcttaactgtagtggtatagccagagcaagaaaaagaatgtgatttaggacaaatgattggatgagtgattggtagatgtcctcagctatggcgtggttttgcaggtcactgttccacccacctgggcacagcatatacgctttttctcttccccataatcccgtaggggctgcgacttctgaagcacaagaggcagaggcgaacagctccaggtgcccctctggagctaccctacctcatctcccaagggagcggccacagcccagagtggggtctttcattttgtgatcttttcccttgacattcagcaaaagccctgacagtggtagaataaaggcaggatgggtgagtgcagagtgattctgcttttgttgggtttcagggaaacccataggcagattctgaacctggtggttgattctacatgtgggaattgtggctttgaagacctctggacatgagaacatatttccaagacagaggattctatggggacgggtcaccattaaatggtgtgcaagcataattctgttcaaaaatgaaggcatgtttagaggtgtgtcacagttaaaaaccaacctgaactttgcagttagattttaaaagatggtcagttagagtagaaatagcttagaatattccattgagtctaagatacagttagaaatcaacatctttgaaattagggtgtgtcttttaatcagttgatgtcagagtttaacgggcagcatttttttctttcttgggattacaaaaaatgatggtgcattctataattggcagcatcttagatctgaggaagtatgatacttgtttgacggaatggttgacggcagaattttgttaaaaagctatatcttcactgtattttaacacattatctaatttaagaaattgttaagatcccccacctggcagaggacccagtacaaaataggcactcaatagatgttacaccaactttggaagggcaaacatatttcttaatgagaggcagtccttcatgttttgcaataaaatgactttt

SEQ ID NO: 260629 - DNA, 491 bp, Homo sapiens
gaattcctgaagttcataaagatgagactacttgaagaagaatttgattcctctctaaaaagattaatagaacttacgagcttaggaacttagaagttcagcaggactgttttatctgcagctgtctttggtcatagtcaatataaaactccacatgcttcacaaatgcgtttactcatctgtttatgtgacactaacactccgtggaagagattgttacaggagatagagttattgagtcaaccccagacactaatcaggaactgactccactttacatggagatatcatcaacagaacatttgaaagtgtaggtattcagggagcactgaaggaaatacaataacattagagttggaagtaaaccatgcagggagaaaaagaccattttttctctttcaaggatgaacaactaaaactggtcgaggaaagtgtgtcagagggctcctccatcttgagagaataggaggaggggatatctgccaagaatg

SEQ ID NO: 260630 - DNA, 641 bp, Homo sapiens
gaggaattggacattatatattaaggacacaagaggtatgagaattcctcagctacagtcggcagcaaatgtgttcgacaagctgaaaggtttagcactaagtacaaggcaagagagatagaagataaggaaggaaagctaaggaaataaatttttcttacaaaactcctctaaagtattctttttataacaggtcttgccagaacttagataagccagaatgactacgttattcttccagaaaactgtttatgaatcagtctgctattttctacccaaaaaaaaaaaaaaagtgctgctcacttaatttgttaaaggacaaagtagttgaatcatcttacttgctgaatctacaggaaaaatactgtcacttctttattgttgtcattttccagtgtttattatgtcataaaatgttaggctttgaagtcccaatctgactgtttagagcagggatctcctgccaactgcattatgtcatcaaatgagcaaacataataaacataattaacatagcaagcatttttcaagtcactggaatttaaaagttgtttgttatagctactggtgttacttaccctgacttatgcacaaaggaaaatagtttcatttcaaataggtagttttttcccaaatagcta

SEQ ID NO: 260631 - DNA, 306 bp, Homo sapiens
atgagaaacaaagtgaccactgatgtagtaattattttcatcaagaaagagggattgcaaggcaagaaagaggggaaggaagaagttatttatgtaattttggggtttctgctgaggaaacctgagtgaactcacttcagatgcatttagaatgtttgcataccagaagatttgatttctgactgctccgatgactactggaatcaggaaggagtgctagagttgggataaaccacagtgcctcattcctgtttattagtatcaggcatcagacatatatttttttttagttattcaaatgagtta

SEQ ID NO: 260632 - DNA, 242 bp, Homo sapiens
ccacaatcaggttttagaacatttccatcaccctaaaaagttaccacatgctcactggcaatgaatccctctcccaaccttagccccaggagagcattgatctgctttctttcactatagatttttcttttctagaaattttataaaaataggtagatatatacatcatacaatatgtatttggcttcttttccttagcataattcttctgaggctcatccatactgttgcaagtttcagta

SEQ ID NO: 260633 - DNA, 507 bp, Homo sapiens
atagttcttttaagtcaaaagtagctaaacacttgaaactagaacacttatttctctagaaatcaggaaaatgttattaaaaggagggaaggaaagaattcaattcctatcgtctcctggaaaacacagaattggaagattcataattatcattataattaatataacaacaactaagatttcttgaggttttactaagttctaagcatcagtacaagcacttaacagatattaactcatttgaccctttccacaccacagaagctatctaggctggaagagaataaagaatgatacttcctccagcaaagagctatgatttttaaggacctgtccagttgaaggagtgataagacaagatatagctggtgcagaagggctggatgatgctctacataggtttcactgtgcaacttgagttgccatcacgtatataaatttatgtaaattgggtaatccatctgctttaataaaatgtgtatgcaaccacagggtgtagaaatttca

SEQ ID NO: 260634 - DNA, 501 bp, Homo sapiens
aggtcccaccagcaggctcaataccccagtcaacagttgagattttagatgctaagtatgaaaacacctccaaattcactcgccacttaataccttacaatgactgcattacagtcgtactagccaattgatttgattctgataacagggctcctacttccatgccaagtgtcccactctaaatactttctaaatctctagttcctacaacagtcatttatccttgctaccatgagattgttattccttgcatcttaccctactttttctcacgtaagtgacctaatgctttcctatcctaaaatgctgaaatagaataatgctacataatccaagctgagatctttgatgttacatgaatcaccttttctccagatattgaataaattactgatcccagtggaatttttaaatttcatctcatttctatttataatcatggaatgtaaccaaggctgaatcttttagttaataaaataattcagcagaaataactataga

SEQ ID NO: 260635 - DNA, 412 bp, Homo sapiens
ctttactttctgttggtattggtaaagtattctttctggctgaagcatctctgaaatatcagaggaaaaatgggaggtgggatccagagggattggaattttagacatctttcaattatttttgtcatttgtgataagtacctaatgaattttgaacctagtaatgcccttatgtgctaactattttggtacctgaggaactggagtgtttctgttccttaccttgtttagtggtctaggaaagaggtctgaagattcaaactctagtctagtttaagtttgtgtttgatagtttacaaatcaaggtgcttaaattcacactttatttactgctatatgcagctcttttttaaagccttttgtgatattttttggtattttgattgtttaaagccctcaggtagcctaatta

SEQ ID NO: 260636 - DNA, 553 bp, Homo sapiens
agctggatattttctagtttctctgttgcatctgcatttagatagattttcttgtttctggtctgtcatgacagtttcattcctttttacagtgttctattaaaccaaaccataccccagcccagtgtactcattagaaaaaagtaaacatttgcatattccctagaaccctaaaactgataacaagaacctaccctccattctggcttttggatccaattttctgttatgtatgatgtctaaaccgaggtggtcaattgttcatcccagccaggcataggatcagacagctgagttccctaggattagactgctagtgcttagccatgactactatggctggttttgttaacctgtaagtatagtttttacttgactaaaacatgctgtaatttatttaccctaccttgagatttttttcttctgtaattctcagcccagaactattatttcaaactaaacttgtatttcacatttttaattagtgaagaggctcaacgaaatgcaattttcaaatagtcacccaatagtataaagcttttgtggaatatca

SEQ ID NO: 260637 - DNA, 620 bp, Homo sapiens
ctggtcttgaactcctgacctcaggtgatccatccacctaggcctcccaaagtgctgggattacaggcataagccaccatgcctggcccatccaggttattctgatgtatgtggtcagttaactgtgacttaagggactgatctagtgacttgcttaaggttatagcctcaaagtggaacccaggattactggcttcaactccactggcagtaatactagcatggtgaatgtagacaatatgatgtggtgatcaccattttaagagagcattcatagaggaaactttatctcaaaggaatgcattgctttcaatagagtttgagataatggtaagtgataggttggtgtgtggtatctgggtaggagaagcttctcatcctgaaaatcatatgtaggtaatgctcaggttgctgaggcaggaagctagcccttaatttggggtcctgtaggtcacagagaatcccctggaattgccgactttgacttaagtgtcacttctagctacaaagggtatctcaactggcgagcaagtggccccattggctaaagccaaggagaccacatctggaaacttaaatcactctggtagcttccagaaagagctacctcaggaaagctc

SEQ ID NO: 260638 - DNA, 505 bp, Homo sapiens
taagctttttaattttcccccagtaacagtgagcagattgctgaaatctctgaagcaggaatgtaacaagagttttgagggctctaaattctctgctgtttcaccctaaggaatggtttggcagcatcctctatgctaggcacagaacaactcaggaggaattgtacaaagaccttatgaaccacatttgaagctagtctgttcagttcccattcaaaataaatacacaactgtaattgaatttatggtgatttggtctgtatgctaaaattaaaaatcgcttttgggggattttcacataggggtatatttataattttctgtgtgctttgcagttaaaaatacatagtgaaagttttatttttgtagttcctctgttgtacagaggaaatttaaattcttaaaattagaattttctaattttaagcactttcatttttcctttagaaggtactttggagcacataaaagaaaatgccattagaaattgaacatagaaaatgtt

SEQ ID NO: 260639 - DNA, 1365 bp, Homo sapiens
  misc_feature (308)..(308): n is a, c, g, or t
  misc_feature (684)..(684): n is a, c, g, or t
  misc_feature (1150)..(1150): n is a, c, g, or t
  misc_feature (1291)..(1291): n is a, c, g, or t
gctccagacagctcagaacagagagactccatttgtttgagagaacataatggaaaagaacaagagtctgcctggtaatccagagaattcctgtgaatcttatccaagactaccaaggcagtacctctgtgaggctgcaagaagcacatcactattgggcttggggtgccccctaatgcagatatgacttagaccacaacactcaagtcattttgaaaacctggaaagcctttccaagaaggatgggtacaaacaagcccagatagagaagactacaataaatacctaactcttcaatacccagacanaaacaaacataagcatccagaccatccaagaaaacatgaactcaacaaatgaactaaataagacaccaggaacctatttgaagaaacagagatatgtgacctttccaagaattcaaaagtgctgtgttgaagaaacttaaagaaattcaagataacacaaagaagaaaatcagaattctatcagataaatttaacaaagaggttgaaataattgaaaagaaccaagcagaaattctagagttggaaaacgcaattaacatactaaaaaatacatcagagttttttaatagcagaattgatcaagcagcagaaataagtaatgaggctgaagacagaccatttgaaaatacacagtcagaggaaacaaaaagaaaangaataaaaaagaatgaagcacacctatgagatctagaaaaatagccccaaaagggcaaatctaaaatttattaaccctaaagaggagatagagaaagagacaggggtagaaagtttagtaaaagggataataacacaaaacatcccaaacctagagaaagataccaatatccaaatacaagaaagttatagaataccaagcagtttaacccaaagaagactacatcaaggcatttaataatcaaactttcaaacatcaaggataaacaaaggatcctaaaagtagtgagagaaaataaatgacatacatctggcaacatagtccttcccattcttccctccccttctgaggcagaggagtctcatcccatggccatcatcccacagagctatggagagtattgccaagccaccactggagcacccaggtatgtatgtgtgtatatatagacaaaaactgtaagagncaaagaagctgactatataatgacaaagggattgatacatcagaaaggtataacaattttacatatatgtgcacccaacactggagcactcagatatataaagcaaatattattagagctaaagagagagatgcaacctanaaggactgaaccatgagccattctaaactcatcctatgatgccagtattaccctgctaccaaaaccggacaatc

SEQ ID NO: 260640 - DNA, 532 bp, Homo sapiens
atgttggctaggatggtctcaatttcttgaccttgtgatccccccgcctcagcctcccaaagtgctgggattacaggcgtgagccaccacacccagccaagaagaaacttcttaatagaggaagggaggcatagggggcagagaggctaaaaaaagttttgtttgttttttttaatttttttacgcttttttttttttgtcttttgttttgtttttttttcctttttctggagaacggggtctcgctatattgcccaggcaggtctcgaactcctgggctcaagctatcctcccgcctcttagcctccctgagagctgggattacaggtgtgagccaccgcgcccggcctaatttttttaaataaaagttctatgtgcttaatatagaaaacttgccaaaaagtccctcaagttcctattctccaaagccagtcactgttgaaattttgccatagttccttacatgtacgcttctttttttttgatacagggtttcactccagcctgggcgacagagcaagagtccgtctca

SEQ ID NO: 260641 - DNA, 1040 bp, Homo sapiens
tcctgcccttcatatttctcaaaggtagacttaataaaggtagaagagacatttctaatttttctatatatctcttgctccctaatttctaaaaggcataactaaaatgctttattcgagccactcccttgcatctgaaccctacctaccaagtaggttaagagtaggttaggtaaggtctgtagctacttctttctttcagttacaaattgtaggtgggaaagaaggatgcggaaggaaacttgcaaggaaagcaaacagaaagaaaaagaagtaaaaaaggagagaagggaatttggtgggtggtccaaccatcaaaatgtggtactaatgccataggtatctacaccacttatgtaagttggaatgttgatgcattccaacgcatgtttttatctttgtactgaaagcccttaagaatacccgaagtaaacatataaaaagtattttaagttcaagttattctttatttcttatgttacgtaaggtactgaagttagccaaggttgctttttagtgttataatgatgcagttcaaagtcataacctgaataagatgttaagtactatagagtgtacaccctaaagataccttaaaaattatgtcctaaataatcagaaattttaataatcatggacatgtatcaacataaaccaaagccaaataaatcagggcttctaaagaaaacgttaaaaaggtgtaatgttcagttataggacatgatactggaggcagggaagacttgaaatctcatttattttcttataatgaagacaccagaagacgttaaaaaaaaaaaaaagatcacgatttccaaacaatgattttcatagtcgacattattttcagttctttatcttgatttagggagcctggaaatttaggacttcgtttcttattaatactaatagtctaaaggtgtttaccagtacaaataagttattgtatgtaatttgctcttctcaaaaaatagagttttctgtatcaataaaaatctgaaatgggggccacaattctgtggctaataatgcctatatat

SEQ ID NO: 260642 - DNA, 220 bp, Homo sapiens
gcttttcacaaaaacatgattctttaatacacatctaataatgcacaatcaatcaatatacacataagaaagcttttcaaattttagcatcccacatggtctctgctgtgagagacaataacgcacttgtaaaatggatgacataaagccctatgcatatttcaaatgagacaagaagatatttatatagttgatgatgtttgctattgtaataatggca

SEQ ID NO: 260643 - DNA, 361 bp, Homo sapiens
ggaaagtatgcaaagtccagtggtttctaaatttggctgatcatcagagtcagcttatgagctcttaaaaacaaaaataggctgggtgcagtggctcatgcttgtaatcccagcattctgggaggctgaggtgggcggattgcttgagctgagaagttcaagaccaggctgggcaacatggcaaaaccctgtcccaacaggaaatacaaaaattagttagtcatggtggtgtgcacctgtagtcccagctacttgggaggctgaggtgggaggattgcttgagctcagggacgtagaggctgcggtgagctttgattgagccactgcactccagcctgggtgacacagcgagaccctgtct

SEQ ID NO: 260644 - DNA, 316 bp, Homo sapiens
tttgggtgtgatggcaggaactaatttcttgtgttttggccagttagctctctgcacacttgcagagtaacaggttctttttcttttgtggcatttaatttgagtaagaccttatatttttagaaattcccagttagctggtaatctctcaaatgaagtggttttttacttgatgagggcatgaagacttttaaaaatcagaagcctcttataaataaatatcttctaggatttttgctaaccacttaatttgtattaactttttttttttctttctgagacggagcctgggcaacaggagcaagactccatctcg

SEQ ID NO: 260645 - DNA, 791 bp, Homo sapiens
cttggccggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggaccgcggcatgtgcgcccggaaactgccccttctcgggggtcgatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttaaaaaaaaaaaaatttagatggacacttgtatttcctaatttatgtatcttggtcagcttctccacaagcttacctaattgtttatatactttatacttattaaagtatacatttttaaatgttactattaataatatcaacattaccagtgtgacgc

SEQ ID NO: 260646 - DNA, 1961 bp, Homo sapiens
ttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagtggatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatagataaatatttacttataaaagtacaagtagacgtatattgtccgttgaataactgaatataccatcaaaggatcaaatcttattacctaattaaaccttaaaaatataatgtcataatatttcttaagaatactatagtattctataatttcaaactttgtggtaaccctacattttatagttgccatatcaaagccatgggagagttttaattcgttattctaagtttagttacaatcccttctttacctctacttaatgttccatatatttttattgactttccaaagtttcaggaattacttttatgtcacattgagtggtaggcttcatccaattgctttgctatggaaatcttggtggtgtagcttttcatgctaatttaaagattgcaagaggtttcttccccaaaatatatcatggactcaaggtgttata

SEQ ID NO: 260647 - DNA, 297 bp, Homo sapiens
ggttcttggtaagtttaggaactgtagttttaatggtatgtggcagcagaagccctactgaaatgagttgagaagatagtgtgataaggaaatcaaaacagcaaatggagacaattcttcttaaacgtttgcctgtggaaaaactgaaagcgtttcctcttagatctggaacacaacaaggttgtgcacttttaccactcttatttgttatagtactggaagtcctagctagagcagtcagacaagagaaggaaataaagggcatccaaattagaaaggaagaagccaacttattct

SEQ ID NO: 260648 - DNA, 397 bp, Homo sapiens
agaaaagaggtttatttggctcacagttctgcaggctgtacaaacatggaactggcatctgctcagcttctggtgaggcctcaggaagctttcactcatggcagaaggtgaagtgggagtaggtgtgtcacatgcaagagagagaacgagagagaggggagggaagtctttaacaactaagtccagagtgaactaatagagtgagaaatcactccttactgtagggagggtaccaaacaattcataaaagatctgcccccatgacccaaaagcctcccactaagccccacctccaacaccagggatcaaatttcaacatgaggtttggaggagacaaaccatatccaagccatagcacctcagtttcttcatttgtaaaattcagataatagagaat

SEQ ID NO: 260649 - DNA, 643 bp, Homo sapiens
atttcagcaaacaaacttagttgttatcagtttaatataacctgttagaactataagattttttgtaagtctaattgtaaccacaaaacagaaacttgtaatagatgcactaaaaataaaaagcaaggaatgaaaacatactactacagaaaatcatacaaccatgaaggaagatagtaaaagtggagaaaaggaggaatgaatctacaagcaaatagaaaacaatgaacaaaagagcagtaatatgtctttacttattaataattaccctgaatgtaaatggactaaatccttcaagtaaaatacatggagtgtctggatggataagaaaacaagaattagttatatgctgcctacaatagacccattttccctataaggacacacatacactgaaagtaaaaggattgaaaatgatattccatgcaagtggaaattgaggaatatctatatccatatcagataaaatagactttaaagcaaaacccataaaaagagacaaaaaatacattatataataataaaggggtcaatacaactaaaggatataatagttgtaaatatatttatgcactcaacattggagcaccaaaatgtataaagcaaatattggtaaacctaaagggagaaatagactgcaata

SEQ ID NO: 260650 - DNA, 841 bp, Homo sapiens
caggtacctaagaactgttaccctgctccaatggaaggtgcttttccttggtgcctaagagcacctttttggcattgaaaccaaacacctttacaccacaaaagagagaaggaggaatagaatacagctgtcacttaccaatgtgtctaagtcttattgctatctcagttaatctgctttgaacacttaaaaaacaaagtgccattctccaagtttcagcttgcactaagtcttaaccagaaggaaaataccttaatttcatttatcttaattcaagatgtgtttgttcatttcttattgtattattaaaaaaatccttctagttaaaaagatgagtgggtatcaaaaatatcagcatttttgtataattaaatttttgtgctggtttttgtacaatcaaaaaccagtattttggggccgggcgcggtggctcacgcctgtaatcccagcactttgggaggccgaggctggcagatcacctgaggtcatgagttcaagaccagcctgcccaacgtggtgaaaccctgtctctactaaaaatacaaagattagctgggcgtggtggcgggcgcctgtagtcccagctactcgggaggctgaggcaggagaattgctagaacccaggaggcagaggttgcagtgagccgagatcgcgccactactccagcctgggcaacaagcgaaactgcatctcaaaaaaaaaaaaaaaaaaaaaaaaccaccagtatttttgtacaattaaaacaaaaagcccactttcagatgaaaacttcaggtgtaaaagtacaagataacgatgaattctgaaggccagcataattcacacactggacttcttaag

SEQ ID NO: 260651 - DNA, 321 bp, Homo sapiens
tttttttttacagctttacagtatctggcatgccctggtgaatgagctattgcctggggtttctgggttttatttttttgagatacagttttgctcttgttgcccaggcagaggttgcagtgagccgagatcgcgccactactccagcctgggcaacaagcgaaactgcatctcaaaaaaaaaaaaaaaaaaaaaaaaccaccagtatttttgtacaattaaaacaaaaagcccactttcagatgaaaacttcaggtgtaaaagtacaagataacgatgaattctgaaggccagcataattcacacactggacttcttaag

SEQ ID NO: 260652 - DNA, 450 bp, Homo sapiens
gtgacaggaaagctttgctcaacttcttatccccctttcactttcagaatcattaatcgtctgtgtgaaaaaactaatctcagtgccagactcaaatctttgctttccctccttatttgaaactttgccctgcaaattctcactgctttggtagctgtctgttgccttcaaactgatttttaaaaaatattttgtttagcctttccgtttgtttcagtatgaaaattggttcaaaacaacctagtcacatcttgtcagaaacagaactgctcaccatttttaatccattaatttgtcttgttttattatatatttgatatgtacaaaggaatatatgtaacatttgtataacatgtttcataatacaatgaacacctatgaactcttagttccttagagttcttagagttttattactcttcaatcctttctacttcctccttgtcccta

SEQ ID NO: 260653 - DNA, 127 bp, Homo sapiens
ataaaaattccaggcctataccccagaggaaatcttatcagcaggtaaaagaatttctcaggctctataaccctggcagagtaggtaaacaagtcagaaacaagatatcctggaaatacatgattta

SEQ ID NO: 260654 - DNA, 375 bp, Homo sapiens
aaatgcctggtatagtttgggcactctatgttttgaaaactatggatatacaaagacggcagcaaccctgtgggtataatcttggtgatgtgggtgtggaggagtgaggctggactggttcctggcagcagggaggaaaagccagtttgggacaggggtgcctgaaactcactgtgcagtttccttgggcaggcccaccccaaacctggcttcagcccaagcctgcctgatgggggcccttcccaggatccccacccacagtcaggacaggtcctggcccgtacctcactcctctgcctgcggctggggtttgcttaagcctcttacattccggagggattgataggattccagaagccacacccaccacccact

SEQ ID NO: 260655 - DNA, 428 bp, Homo sapiens
aaggaagagatcatataactacaaacccaagataatcaactaaaaaactactatagacaatacaaattcactaagatagcaggatgtaaaagtaatgtactgaaattaatagctttcatgtaaacacagtcaattagaaagcatagtagaggaaagggggcaatttaccataacaagaaaatgattaagtaccaaggagtacatttaacaaaattgtgcaaaacctatacaaggaaaacttaaagatactcctgaaggaggaaaagaacaagttgatcaaacgaaaaagacacaccaagtactgcaaatcagtattataaagctgttctctctttatatttaatgtacctgaatatgtatacaatgtttccttgacttagacaagtccaaatggaaaaaggaagaagcaggcataaccaggaaaactt

SEQ ID NO: 260656 - DNA, 703 bp, Homo sapiens
gctgaggtagcccatgcatatggcacaagacttactaaagaatagctgcaaaggactgaaggagaaaaagaagtgtgtgaacgaaaagtatgtgagacagatctcaatcaacttagaaagtttattttgccaaggttaaggacgtacccgagacacagccttaggaggtcctgacaacgtgtacccaagccggttgggcacagtttcatttcatacattttaaggagacatgagacatcactcaatacgtgtaagatgtacattaattcagtctgggaaggtgggacaactcaaagcagggagggtgcttccaggtcataggtagataagagacacctggttgcatttttttgagtctctgattagcctttcactgaatacacaatttacatgtgagacaggggtaaaggaatacttacttctgccttagtctggttcagtgaatctgcatttttacatcaatagtagggcagaggaagcaatcagatacacatttgtctcaggtgagcagagggatgattttgagttctgtcctttgtcctatacctgtgaagataaactcccaatttacattgccaggatgaaattcaacagaactgttttagggtaaagatcttgaggcccacaaggaattttgctgtgggcaaattgtgagggaagcatgtagcttttttatctttgtgttatagctaccttatttggg

SEQ ID NO: 260657 - DNA, 332 bp, Homo sapiens
cacatactcctagtgatggagggctctgggttttctgttcatcctcatcactctgtgcttattggctacctgtccatgtgtaaataacacatgtgccctgtgctcattggaaccgtgagtcatccgcagggattcctaagagggcccatgagaatggctttcactcctccagcctctgcccttctgacctcctccacaggcttcagccttatgggagtccccaagtcttggaagcatctctagtgagtgcagtgactccttagctggttccttttcaaccttcaacctccattttcttaacccttaccaactctactgcccagctgcaccca

SEQ ID NO: 260658 - DNA, 398 bp, Homo sapiens
aagaaagtttgtttgagatcctatgtgtagaatggacttgattcctcttgcactgaaaaatgccttaataaaaatgaatggttttgcccatactgtaactgtagtttaggtccatttgactaaagcttgagtccatcttcggacattttgaagaatttcttccttttaaagctgctatatttactgatatttccaccccctgggaatctgcttctcttgtttattagagctgctaaaatgaaagcttgccaactgattaattttaatagtttagccagaaacctgtggataatgtatattggctgccaagcttgagataaattctgttggctctgttgcaaagattttggcagaaatgtctgccctttgcgaagcacagaggaactggagggaatgcg

SEQ ID NO: 260659 - DNA, 427 bp, Homo sapiens
atataaatatattatctttatatacacatatctatgtatatatacacaaacatgcgcatatataggggcacatacctattttattaaaagactaaaggcagcaaagtggagctgtaaacatgaaggataaatcatttcatacctggaagagtgctgtctaaacactgcccatcacctaaccaagagtcatcatccctaactttttttcataattgactatttcagttaatagccctaggcttcaagaaaggctgcgcatcttggaagtattagggcatgagtcatgagtcttgattcttccaaataaaatatggtaactctttctagtgatttgtttaggaatgtatgtgtaagatgatgatgggaagtctactggaatctctgagagaagatttttcttgcaaaaaataaaaagacctaatgaaag

SEQ ID NO: 260660 - DNA, 416 bp, Homo sapiens
ccttaaactctcccctgtctctgcactccacagaggaacatttcccatcctcctgtccttccaatgtagttataatatatagtaacttttgttaggtatgttagtctttaccttatttttactatctgaatgctgcttatagctgtatcttatgataatgtatgattacttttcctttttatataatgttttgcttttcttgaaatcactagttgtcaggtattatcctagaactctgggatatgcagttttttatgtgtagctgtcatactgggattctttcaccatcattctgaagctggtttccccgtttctcttgagttagatctcctttttactccatctcttgttgtcctcttttaaaaaattcattatcttattttagtgaaatgtatagttaagcagcttcttaatat

SEQ ID NO: 260661 - DNA, 367 bp, Homo sapiens
catggcatcattcctgcaacatcttattggttatataggtaagtttatgcaatgtgggaagggactagacatgggagtgaatgaatgctaggaggtgggaattactgggtgccatcttggaaactggctaccacatctgtaattatagaatgttatgaactggactgtgataaattccaagtacagccatccttggagtctgtgggttattagttacatgaccccttttggagatcaaaatccaaagatgctcaagtctctgatataaaatggtgccctattgcatataacctatgcacatcctcctgtatactttaaatcatctctagattacttataacacctaataaaatgtaaaaattatgta

SEQ ID NO: 260662 - DNA, 301 bp, Homo sapiens
ggattggttagagggaacaagatcaaatacattagtttgtcaaataatcagcaattaaaatagaaaacatccactggtccatggaaaaacaaacaaggaaaagctacttttctcccaggggacacaagaaccaccaacatttaaaattacctggatccactttttaagggtgaaggtataaattatatgcaaagtgtcaacattggggagtcaacaagacccaagcgcaaggaacattaccagttgcaacagtctagatacttcttcggacctcagttttcagtctacaacatagtgatta

SEQ ID NO: 260663 - DNA, 434 bp, Homo sapiens
tactacagaacctctttacagatgagaaaataagctaaaagagactgagtaacttgcccaaggttattctttatcgtgcagggacaaggaatttgatacatagcctgcctgactcaaagtttgtgctcttaatatattcttctgtctctcttaatgattatttctgactcttgtcaagtttgttactttctctaacttaacatcattggcattttgggcaggagaattctttgtcgtgtggggctgttccatacctggtgggaagtctaatatacttggttccaagcctgacatgccattagcttccgccagccattgtgataatccagaatgcccctacatgtttctaaaacttcttactgctgggggattccatggttggggattttggaattgaatatggatgtggctgtctagctcacgtcaccatgata

SEQ ID NO: 260664 - DNA, 330 bp, Homo sapiens
ccagttactcgagaggctgagataggaggatccctggagcccaggaggtcgaggctgtagtgagctgtaattgtgccactgcactctagcctaggtgacagagtgagaccctgactcaaaagaaagaagaatactacataagttatgtcgtgtacctcttaccacatacattaggttgtcctgccattggggatactaagtttgaacatctgcttaatgtggagttggccaggtctctccactgacacatttgtaacctacagttaatcagcagggtgatattttgaatatttcttgttcttaaaagacaggctaaaataaagatatgag

SEQ ID NO: 260665 - DNA, 394 bp, Homo sapiens
atacctaataaatattggggtgtgtccttggctttgatctgtacatgctgcatattctctctgggcaatcttatccaaattcaaagcttcaaaaagccaactatattctggtgatgcccaaaagcacatatctgatcctgagttttaccaactccagactcttaattaaattgggcctatctttaaagataatgtggccaaatgtatagtcatactcgttttctcttttcaaagtctgcttttccccacataagtcctatcttgtctctatatgctcaatccagaaatcagggtcattcagattctgttagctcccacatcaaatcctcctatctttttttcctctaaatagcattcaaatgtctccttccttatatgctcattgcctcattat

SEQ ID NO: 260666 - DNA, 471 bp, Homo sapiens
ccagataattgtacgagagtgtagaggggcagaaatgcacaggatactctgggagcatcaagggaggattaaaaggactgggttattggtgtagagatttccaggaaggcttaccataggcactgatggcaggcaaagacaggtaattaacaaggtaaattggagaaaactggatactttaggcagaggaaatgcaatgggcaaaagcctgtggatgagaacctggtagagggacgatgtgttacaaatgctgatggtgttttattcaattcttgctttcccctgggagaaatgacttttgggtacagtgcatcaaggaagattcagaaggtaaaggtggtgagagatgtaggttaaaaagtcatcgtctgttttcttagtttgcctgatttcttagtttgcctgatttcttagtttgcctgctacacaaagtgaagcagaatgcagttgagtgatttatgtccatcataa

SEQ ID NO: 260667 - DNA, 465 bp, Homo sapiens
acccaacatagaaagcctcaaagcaggaagatactacacagacttccaaagaagcagtgagaggacaccatctgatgctggctgcaccaagaagcctgaatggctgtcagtgtcagagaggaaagaagaaagatgagagggaaagctaagaaaaggtgagaagaaagggtcaggaggagaaatgcaaagagactgggataattttttggaccataccttctctgctggcagcttactgtgactgcaccatccaaaatttggtataaggatttggaaatttgaccaatatttcttagaaggattttgcaccatcagatacattttgatattagaagataaagagattggcccgaaactgggatggaggagaagcagccaaagagttgttctgtttcttaagttactttgaaggttgtacacttttaatattcattttgaggaataaataatttagacatccaatta

SEQ ID NO: 260668 - DNA, 425 bp, Homo sapiens
agcataagcgttgcctagagcaatgggatctgacgccttttgacgccccttgcagtgaatgaccccagcttcctttagaggaaagaagaaagatgagagggaaagctaagaaaaggtgagaagaaagggtcaggaggagaaatgcaaagagactgggataattttttggaccataccttctctgctggcagcttactgtgactgcaccatccaaaatttggtataaggatttggaaatttgaccaatatttcttagaaggattttgcaccatcagatacattttgatattagaagataaagagattggcccgaaactgggatggaggagaagcagccaaagagttgttctgtttcttaagttactttgaaggttgtacacttttaatattcattttgaggaataaataatttagacatccaatta

SEQ ID NO: 260669 - DNA, 315 bp, Homo sapiens
tctcatttgcttcaatttgccgaaagatcaaatactctcctgagtccttcttttctctccacgaacttgccaagaattctgggatcaactctatttccataaaacaggaagagagaaaaggaaaattataaggccccttggggtcactggattttgcaccatcagatacattttgatattagaagataaagagattggcccgaaactgggatggaggagaagcagccaaagagttgttctgtttcttaagttactttgaaggttgtacacttttaatattcattttgaggaataaataatttagacatccaatta

SEQ ID NO: 260670 - DNA, 156 bp, Homo sapiens
aggagtctccttgaaatgacaatgggatttgtgcaacctgtgacattttgcactcaaggatccttttcccagtgccctatgggatgtgagcacctgttcacttacagtacatgtaagataagacacttttaataaaaactctggagacctggtgta

SEQ ID NO: 260671 - DNA, 512 bp, Homo sapiens
  misc_feature (498)..(499): n is a, c, g, or t
aatgtggtgtataaatataattgaatattcagcttttaaaaggaaaaacattctgacacatatacaacacgatgaccttgaggatgttatgctaagtgaaataagccagtcacaaaaagactaataatgtatgattccatttatatgtggtacctagactgcttagcagattaagggatcttcaggatttggagtataagacacacctcggccttccaaagtgctaggattataggggtgagccactgtgcccagtgctgctccttttttcttgcaacatgcggattaccatacctttcctcttttcacctttagcccactttttccctttaaatactgaagccctcagcatcatctctggagaaaaggcacagaccagactgtttctgggattccctatttagttcttccaggcatgtccttaaccttggcaaaattaacttctaaattgttttagacctgtgtcagataatttttggtgtacaaaatgtggtcacnntcccccaagattt

SEQ ID NO: 260672 - DNA, 467 bp, Homo sapiens
agtcaaccaaggtaagaaatttttactttgtcacatactcatcgcatgagatgttcctgcaggatatgaccattgtcatcttccataagcttatcaatccaattgattagttatagccctattagggcacataattgtgtctagtagtgttttcatagttactctagtaagtagtcatccagatttcttctgcaagttgtggaatttaacactgttttgttaatgattagtgaaagtattattttcatgtgagaaggataaaatattccaatttgaaaatgtatccaagtagaatttatagtaacattataactttctctttcttttgtcctattaggcagttaagttcaagtaaccacagggcttttgctcttaaagagatctggctcagaatgaataccaggttgaagaggctgagacagagcagacttgctgaaggatttgggggatatttaggaataatgtta

SEQ ID NO: 260673 - DNA, 498 bp, Homo sapiens
caaatacaaaagataaatgaagcaaaaagctggttctttgaaaagataaataaaactgacaaaccattagcaagattaactaagaaaagaagagagaaaatccaaataacctcactaagaaatgaaacagaagatattacaactgaaatacaaaagatcattcaaggctactatgaacacctttatgcacataaactagaaaatctagaagagatgggtaaattcccggaaaaataccgtagcttaaatcaggaagaattagataccctgaacagaccaataagcagtgagattaaagtggtaatttaaaaattatcaacaaaaaaaagtccaggaccagacagattcacagcagaattctaccagatattcaaagaagaattggtaccaatccttttgacactattccacaagatagagaaagaagaaacataccctaattcattctgtgaagccagcatcagcctaataccaaaaacaggaaaggacataaccaaa

SEQ ID NO: 260674 - DNA, 514 bp, Homo sapiens
tcagtggacaactggggactggaacatggggaagttgggtggttacaactgtaattaatagaccaatctgtggcccacatgagatccacctgaaagaattcttgcccagctctgtgccttcttcctaagatgtggcacccagaatggcaccaaacatgcctagtgaggtttggatcaagagtaagctggcttctctgctatgttttcagtagccttcctgaaaacacccagcatttgtttagcttctttagctttagcacgtgtttccaccagtgtcccttaacggagaggatgactatgtcactgaagaagtggaggggctgaaaatggactcagctcttggcccctgtagagactgcaagactccgtgcacaacgtgacagtcggggcttcctctgagcactgcgccgttcagccctattgcgcaacctgccacgccctgttactgtaaatggaacaccggctgtgagctggtcaaggccctgccatgacaaggccacttgcataggactcc

SEQ ID NO: 260675 - DNA, 200 bp, Homo sapiens
gtggactgatttaagaattgataattatacagtcttcacagaactcagaaaaatggtaaatttttacattcatattgggtgtttaccaccttgggaaatataacaaaaggaagaaatatctaatgtttttgattttctagtattgccgtaagaaaacaaaaataattctctacttgtccactatttctggtcccagactg

SEQ ID NO: 260676 - DNA, 433 bp, Homo sapiens
ctggagattctgatggttgtgtttctgaatctgaattttttaacaagcccctcagggtgattgtgatgcagctgtcagtggtatgggatccagtaccttagccatctgtgccccaatcgccttacatgtgaaagtgcgtaattaatacttgcctggctcctgtaccacacaggattcagagagcatgagatgagttgtatttcaaattatttcataaatttaaaagtaccgtaaaagactgggcacagtggctcacacctgtaatcccagcaaactttggggggctgaggcaggaagattgcttgaagtttgagagcagcctgggaacatagcaagacctcatctcttaaaaaaaaaatatatatatatatttatatttatatatttttgtatattttatatttatatatgtgtatatatatatattttttta

SEQ ID NO: 260677 - DNA, 426 bp, Homo sapiens
atcacttgagcccaggagttcaaaaccaacctggacaacatttctacaaaaaaatgtaaaaatttgccagtcacagtggcatgcctgtggtcccaattactagggtggctgaggtgggaggatcatctgaacctgggaggtggaggccgcagtgaggtctgatcacaccactacactccagccttggcaacaaagtgagacctcacctctcaaaaaacaaatcatgtatatggacttagttcctttaacgtgaaataatgccccatatgtgtacactccattgatttgtaggaaaaaattgatgcaaggatgagggatgcataaaggaagaatttctccagtatctctcaatctttttttctttttctttttctttttttttttttttttgagactgagtctcgctctgttgcccagtctggggtg

SEQ ID NO: 260678 - DNA, 381 bp, Homo sapiens
agagttcttgccattaccaactggtaagagcggctcactgcacccaaactgtttataggaaccatgtggtttgtgctgaacatctgctttcctgtggcacagtctgaaattttgatatatacctgttagaggcggcctgtgtgaccagcccccagtaaaatgctgaacattgagtttctaaggagcttccctagtagacatttcacacatgtcacaactccttgcctggggaattaaacatgttccatgcgaatccactgggcaaggacccttggaagcttgtgcctggtttctcccagcctttgccccacgcactttttccctttgttgatctcactctatatcctttcactgtaataaatcttaccaggagtaaaacta

SEQ ID NO: 260679 - DNA, 915 bp, Homo sapiens
tgggctttcatttgccttgttttattgaatacaatacacttccagaaaaatgcacaatcataagtgtacagctccgtgtacactctcttttacaaacagaactctcttagtttattttgtgctgctataacagaacacctgagactgggtcgtttacaaagaagagagatttacttttcacagttctggaggctgggaagtccaagatcaaggcatcagaatctgatgagaaccttcttgctgcatcctcacacagcggatggtggaagggggtgaacccacgcccacgagccctttttatagcgtcattaattcattcataagccttcatgacctaaacacctccagttaggtcccacctcccaacacggtggcattggggatgaagtttccaacacacacattttggagggacacattcaggatatagcaagaacacatcctctaaacaaagacatagaacatgaccacagtttccacaggccctttttctccctccagttactactcacatctacagcaagcacaatcctgatttgtaacagcaaagttcagttttgcttcttcttaaccctatataaatggaatcatacaatgtattctcatctttgacttcttttgctcaacgctgtaattctgagattcatacgtgttgctgcatacagtttgttaatcctcatttctgtacagtgttctattctatgaatataacacaacttatgaattcattaccctgttgatgggtgttggtatcatttccagttttcactgttatatgtagtactgttatgtacatatgttttgatgcatatatgtatgtgtatgtatgtttctatggggtttgtactttagagtggaatttctggtagattgggtttgtgtatgttcagctttaataaacattgtcaaataaca

SEQ ID NO: 260680 - DNA, 105 bp, Homo sapiens
  misc_feature (91)..(92): n is a, c, g, or t
  misc_feature (94)..(95): n is a, c, g, or t
  misc_feature (97)..(100): n is a, c, g, or t
  misc_feature (104)..(104): n is a, c, g, or t
cctcgccctggccctggctgggcggggaagctggggtgagggacgagtccacgggacacccaaaggcaacatgacggaaccttgccaaagnnanngnnnntgcnt

SEQ ID NO: 260681 - DNA, 673 bp, Homo sapiens
ctcaatgggaggcaccaataagagagcacaggaaaggaagagaaagagtttggggaatttattctctggttaccttccagctgagccatgggttggcagtgaccaccttctcaactgaaagctatggcttctgccaggaactcctctatcacaactgctgctgctatgtctgggttccagaaacccgagctccttcaaaccttggtgtggtaagagcgccactgttcctagctctgggttgcttcaactatctcataatgagttcccctaaaccttccacaactttgtaaacagacgctttgcttggactctcctctgttgactttgttggtgtgtttcatttccagacctattctgatgcaatatccatgagcagaacattcccacaatattccttatggtgaccaggaagtgccctgtccttaaatggctatcatgggaatgggaatactggaggtatagaaaaaaccaaggctatcaatgagagtgtaaagaaggtgaaaggagagaggcagatgaagattgttgagaccttcaggatcagtgttgggggtgttgggggtgcagaggaccatggcacaatgacctatgggtttggatttgaaatgccctccatttcccgcggttttaataggccacacttccttttttggcaagtttatagaagtcgggt

SEQ ID NO: 260682 - DNA, 621 bp, Homo sapiens
ctcaatgggaggcaccaataagagagcacaggaaaggaagagaaagagtttggggaatttattctctggttaccttccagctgagccatgggttggcagtgaccaccttctcaactgaaagctatggcttctgccaggaactcctctatcacaactgctgctgctatgtctgggttccagaaacccgagctccttcaaaccttggtgtggtaagagcgccactgttcctagctctgggttgcttcaactatctcataatgagttcccctaaaccttccacaactttgtaaacagacgctttgcttggactctcctctgttgactttgttggtgtgtttcatttccagacctattctgatgcaatatccatgagcagaacattcccacaatattccttatggtgaccaggaagtgccctgtccttaaatggctatcatgggaatgggaatactggaggtatagaaaaaaccaaggctatcaatgagagtgtaaagaaggtgaaaggagagaggcagatgaagattgttgagaccttcaggatcagtgttgggggtgttgggggtgcagaggaccatggcacaatgacctatgggtatagcattaggaattcaagccctccca

SEQ ID NO: 260683 - DNA, 382 bp, Homo sapiens
cactcctgttccctcagggactagaacgttccttcctcatcacagcttgcggtggatggagaggctcacccttcctgcagggtctcaaaaaaataaaaaaagaaaaaagaaaccacgcatgctgtcaccgaataagacaagcctactcgggaaatgtacacccagctctttgctttgaaatcttaccctggccaaggctgcggcgctgagagtgtgcagagtcagacggggaaaacggaggaaagaaagaacttctctccccagccactgcgcagacagcagtaaaggggcccacagaggcctaacaccccaatctgcagggtagcccgggtgcatttgccccatcccacctgccagctgcaacacccgccccatgcctcta

SEQ ID NO: 260684 - DNA, 253 bp, Homo sapiens
ctgtagagttgtgcttctcaaactgtaatatgcattagaatcgcctgcagggcatgttaaaacacagattcttgggctctaccccagagattttgattcttcaggtctgagaatgtgcatttctaacaagctctcaaaggatacagatgttactggtctgaggcagccaggtgctaagaatcaaatcctttcatgcgtcctaagattaagttaaattaagatcaaattgaacttaaaccaaaaaatagaaaaa

SEQ ID NO: 260685 - DNA, 2857 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagcttttgtttacattgtcttggtcagttcctaaatcaagtgacctggcctagcacccctcttcagaagagatggtgggagcaccttcaaagatgtcacatgggggccgggtgcggtggctcacgcctgtaatcctaggaccttgtgaggttgaggctggaggaatgcttgagctcacaagttcaagactagcttggacaacatggcgaaaccctgtctttggaaaaaattagccaggcgtggtagtcccagctactcaggaggctgaggtaggaggatggcttgagccttgggtgtggaggttgcagtgagccaagatcacaccactgaaatccaacttgggtaacagagccagaccttgtctcacaaaaaaaaaaaaagaaaaaaaaggaaaaaaacaatgccacatgagcaacagtgcttacatttcctgcttgcttatcagtaaggttaactgctgatgtgctgtttcttgtgtccaggtattgcgctaggtgctgtagttgcctctgcagtcctcaaagcaactttctgaaataaacattgctttgcttctctaacctctgagaagttagacttgtctaaaacctcatggttaaaaagtggctatgcagaatttgaacctagctctgatgccagagttgctcttaacccttccagtaccacataagaaatgagaaacttgggccaggtgtggtggctcatgcctgtaatcctagcactttgggaggctgaggcgggtggatcatgaggtcaagagttcgagaccagcctggtcaacatggtgaaactgtctc

SEQ ID NO: 260686 - DNA, 2064 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260687 - DNA, 1975 bp, Homo sapiens
aaagagtgggaaggaaccctccacacagaaggagagaccaaggcccactctgatttcatcttgagttgcctagtgccttctccattggcatatctgccatctcatcccatagatcctttctccccaggtccacaccagtagtcgtgggccatgaactaagaccccagatcacaagaatctctccccatgaatggcagtaaaacatttctcttaaatctagagactactgacctttcaagcttgaattcctgttctgttccaactattcatgattccctttgatctcctctgacctgtagaaagggaagcacccaaatccatagccctatggccaaatctcaggctggggttaacttttttttaacttattcatcgtctttcttattcacagactggattttctcagatgtaaaggtgggccaagagccaggacggcccatctctttcaagttagacttcagcagggccaggaacacagatggcttgagatgattctaaggctagggagggaaggatgcacaattattcctaactttcctaagggggaactaaggctccttttcctactgagatgaggctccagagactgtggtgttcccagggctacaaagctggggcaactgagttaaattccaatagcatcctgactccaaagcccatctacagaagaccagctgagggtttctttttctagttacagaagtaatatatccctatcacagatgtcttgaattagacaaagatataaaatagaaatacatagctaacatttgttgggtacgtcaagcattttattctttacaaaaccctgaggtatagcttttatcattgccatttctagtggagagaaccaaagtgcagagaagttgggattatttcttgtacaacactggggtggcattgggcctgcaggggtcattcagcaggtggctgctcagcttcggactgggagggtggctggctgactggccatgcctgaagccgaggccttagctctctgttgcctttcagatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260688 - DNA, 439 bp, Homo sapiens
gaaacccgcgccttccctttggaggcccgtttcccctcccaaaaaaaagttatttggaaggtccccttttccaaggccaaagcgaaaaggttcccaaaaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttctgtgcccatttcagggccgagct

SEQ ID NO: 260689 - DNA, 2744 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagctaaaaaaaaaaaaaaaaaaaaaaaaaaaacaaaaaaaaacaaaaaaaaaaaaaagagacgagggggccagcaacaaaagaaaatcacacggaggaaggagcacacagaaaaaggacgacaccgcgtattgtaggaaagaagaggggcgccacaaaaggagggagtcgttgaataaacacaagaagagaacccgcggggcgggaaataaaacaaccgccagccgtaatcacaggggaaacaaaagagtgcggccggcgagaggcgcaaacttggtgcaaaagcaacacccacacacacagcgggaggagaaccaacaataagagcgacccaacacagagaaacaccataaaacaacgccaacaccgaggagcgacaaacaacccaacacaaaggcaaaacagattccaaaacggcggctgcacaaaaaaaaagccgcaaaagaacgcgacgagcgacgcagaaagaacaacgccgcccagcagcgagacaaaaaaacgaacaaaacacatcttacaaagcggggcgaagaccgaggaagcgcgacacagccgacaaggcgagaaaaagccgggaagccgcaaacgaaagaagaccaaaaaaaacaagatcaggggccgcgcgcgcaggagaagagaaaaccgagaaagagagggggggggcgacggcggacgagagaggcaa

SEQ ID NO: 260690 - DNA, 2785 bp, Homo sapiens
tataaatgatgcttttgtttttgtgaaactggatttacaccattgaggatttgggctgttaaatgtttattatttaacttaatgttgatttatattgaaattgtttaattgtgggtatgctcatctgtagatttctgggcagagactgattcctgatgtcatggaatgctaacatgtgaatgttcatgtaaggaaatacttctttctgtggaattaaaattacattaaaagctaagcaagtatacctggccgggtgcaatagctcacgcctataatcccagcactttgggaggccaaggcagatggatcacttgaggtcaggagttcgagaacagcttggccaacatagcaaaaccctgtctcgattaaaaattattttaaaaagaaaaaaaggaaaaaaaaagttaagcagttaaaaataaacaagaaaagctaagcaattatatggataagtacatgttcactcaaacctggagcagctggttttagtatatgtacggaatgggtatttactttctccctttggcgttttggtttggtttggtttggtttggtttagaaactgatgttttgaaataggtcttacctctcagactcaagtaactttttaaccttgcagtaacatccaatcaacttcctataagggattaaaaaaaaaaatccaaattggtgccctgtgttaatttgatttaatcctctttcccatttttccttatttatattgatctcaccattaattgtgctaatctgggttcttccaagctcaaaatgagatatcaaggagaaagtaatctactgaatgtaattccttttcctttttttttctctgaaaggtgggggagtggtactaaggatcaagtatactgttaaaagaaaacaaaaacccaagcatgaggaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260691 - DNA, 1488 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260692 - DNA, 1656 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260693 - DNA, 1695 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttactataattaactatttgttacaaccctaattaaattcctcgtctctgtaaaaatgcttattttctcactaatgcctttggccggccagtaccttggttctctcaacttttaaatctaacagtagggggaaaattccctatagcccagatgttacatagttcttagcatcaactatctgtagatttctgtgtaagtcacaaaaagctgaggttaagaacttctgaactaggctgggcttggtggctcacaactgtaattctaggactttgggaggctgaggcaggaggatcacttgagcccaggagtttgagaccagcctgggcaacatagagagatcccatctctaa

SEQ ID NO: 260694 - DNA, 1654 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtgaggggccggtggagccggacagaccctcctcgccaatcctatcctgccagggcacctgaagcgcctcctttctttccgccttagcggttacctagtcgtcatctcggagagctgcgctgaggggggtcgcttgcccggcttcaggtgccccaaccgagccagggcaggctgccggaccctctcgagctcctccagtgccacccccgtcagcgacccgagcggtggggagaagccgggcgtccctagcgttcgcgccgggtgggcccctctctgcgccgggccctgtgcgcctcctcgggggcctgaggcagagccgccaggctcgcctgagcctcggtcccttggcgcgcggcgtgccctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctgggcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttctgtgcccatttcagggccgagct

SEQ ID NO: 260695 - DNA, 1141 bp, Homo sapiens
actctagaggatctcttctgcggtgcctttcccgccccgagtccttgaactaacccaagtgttggggacatcgtgggaccgaggagaacaggaggggtgcagggggtggtgaggctagggccaggctaacgggttaaagaactctcagggtggggatgccacccggaaggggtgcttcgtaggctgcacgtcggggccgcgaactagagaaggctggatgtgcctccatcgccactaggtaaacgcagcaaggaatttggcagcttgagttctccaaggtgggagtgagagcgtgggagcattactgatgagaagttgaagaaaaggggaaaggggagcggggtttccggcctacttctgagagatgattctcaacccgatcactgagagttctgaagagctttgtgaacagcagtcagttcagggtattgattcatttgccgaactcaaaccaagtgggatgagtcataaggtgatgataactttcagacctagatggtttcgttaatctcagtgcagaggtgtgctgggggtgggtaatctagcaggtgagctgctagattaacgctgtctccataaagcgtcaaagatttactatagaagattgaaaaagagtgtcagctgggcacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttctgtgcccatttcagggccgagct

SEQ ID NO: 260696 - DNA, 654 bp, Homo sapiens
  misc_feature (26)..(26): n is a, c, g, or t
aggagcatgagagtgtgatgctctgnagattacagtaattctgtgtccccaaaaagccagcgctggcatagatcttctgcctgtagctcgcagagatttagttttccattttactgctaggaatttctgtgcccatttcaacagaaattcagcacatgttttgttgaacgttttctgtgcgttagccaagagggagacatggtgaagagaagtaattcaaaatacagtctcatcccttaggaaggcagtttaccattcaaaagaagagttatttgtaagtaaccatattacaaggcagaaggctataggtatcaaaaaaaaaaaaaaaaaaaaggcagggacaaaacacaggagccagaaaggatacttctggctacagaaagcaaggaatatttttggaataggtaactttggaactgtgccttgaagtatgaggatattgtaaaagcttatttttaactttccagtttagttataaaatattattacagcttgaaatatctattaaagtatctagaagtagctttatttcctgaaaaccaccctctgctgtgttaagatccaaaaacaaagcagggatctttatatataatgcctcgaagaatcagtatctttattaatattaaatttctgtgcccatttcagggccgagct

SEQ ID NO: 260697 - DNA, 1191 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacgagggggtaactaattacacccagggcccggcacgcttattcttggccgtatatggtggggcctttagtgcttgatgacttctgataaacttcaagtcatgtgctggagtgaagcttccacacccagctgaactctgcacttaaaggctgtcctgatgtatagtgtctgctgaggtgctaggtggctccaaagtctgctgtctgaagggtcccaaaatagctcatcagtctcttggccttagttaatttctctgtcttacacagttagacactaactgttgaagaaatggctgtgaaaaagtagcacatacacatttgtagtgttatgtgttagtgcacgtgtttcagtgaccacagaaaacaatcagtagtgtaagttagc

SEQ ID NO: 260698 - DNA, 695 bp, Homo sapiens
gtgaggccacctataaaatttggtttccctgacatgtcagcctgacaggaagggacagtgccctgtggacattcgctagattagtacaggatgtttcttctggtttgaatgtaggacagtatactgaaacacttctaggactgctgagatggctgggagaatattcagggccagtgatgagtttagagtggggagggtctggacttatgggaccagggctaatggatgctctgtggtttcagaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaagtgagttagaaaattattcaatttggtttttcttacta

SEQ ID NO: 260699 - DNA, 2277 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctgtaggtttatcttttcattttttccctgtagtatttttccttaggcttttaaaaactgggttgtttttgtcacaattaagtcaaatttatttttgagaaagctgtgtaccattttactgagtatcagttagttacatgagcctgtttatagatctggaaaggagtaacttcattatgtgatgttcattatggctgcgagaccaccactgccaaatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260700 - DNA, 2130 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtgggggagtggtactaaggatcaagtatactgttaaaagaaaacaaaaacccaagcatgaggaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260701 - DNA, 1955 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcagaattaacatttcatagcaagtgcattatttaataaatagtcttgggacaactgactaacatt

SEQ ID NO: 260702 - DNA, 1437 bp, Homo sapiens
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagct

SEQ ID NO: 260703 - DNA, 701 bp, Homo sapiens
ttgccttccgccatgattgtaagtttcttgaggcctcctcagtcatgcagaactgtgagtcaattaaacctctttcctttataaattacccagtcttgggtatgactttattagcagcatgagaacagactgacacagatggtatatgtgcataataacttggaaagctagatatttattttcgcaatgctacaattaaaacattttgaggacttttaaaattacctttagagccaccatgcctggcctagatattttttattctttccaaaatttaattctccctgaagttaaaaattttcattactgagaatgtacatagagatgtgtcacaaccctttagtaattccaaaaggtgtttcaaaaattttatacaatgataatcactgttgaaacaggtgtatattctcctcagatcatgactgaccaagatgatattccaagaagtaaactactggcctttatagagtaggatgtaggccattttcattactgataacatacttttaaaagaaatgtttacagatttaaataagttaaaacatctaaatgcttttaaaagagcacctggcacattgcaagttattcattattaattagtagatgaatcatatatctggagtgcacccttgctctatatgaaagcttccctaactatagatatataggtgatagactgacaataaagatttgaggaaaga

SEQ ID NO: 260704 - DNA, 317 bp, Homo sapiens
caaaatgttatctttcaaagcaggagagttagttttacaactacttcttaaaacttggaataggccaggcatggtggcctatttgggaggctgaggcaagcagatcacctgaggtcaggagttcgagaccagcctggccaacatggtgaaaccctgtctctactaaaaatacaaaaagtagccgggtgcatgcctgtaatcccagctacttgggaggctgaggcaggagaatcgcctgaacccaggaggtggaggttgcagtgagccgagatcatgccattgcattccagcctgggcgacgagtgaaactccatctc

SEQ ID NO: 260705 - DNA, 1182 bp, Homo sapiens
cggtcatattcctcttacgtttctaaaattctcctagtagctttaactgattattcaaaatggagacagtgctttgcttcttgattttaagatttgtaaaatttaaaggtacactgcctttatttgattttgcttggagtcactgtgtgaaaattaattgagcgttgacaatctatagttagtaccagcgattttaatcaatatgcaatgatgcagcgtaatggcaaagtattggtttatctgttttgactgatttttttctataaataaagcaaacatacacccatatatgtatgatttatggtgatagaaataaaacggagtcagactattaacccagcaaatatggtagcctgccaagatgcagttggcaggcaaaattaatgtctgaaacagaacacattactgagataaaggacataaaattattaaacacttcgtgcatccatttttaccaggaaggagtccttagtttccgtgtattattttacagtaaatggctataggactagatgtgtaggctaccaaaaagaaaggaaaaaaaagaaccaggtcattcactgttgtggcatcagtagtcagctgtgctatttctagcaacccctccttctagaacccagctaagcaaaatggtgagcctctgagacaacttggctgaagtcatctcgaagaagcatagccaattgcacagggcattcactgccttggaactttttgaaagtcttcagatggctttagtgaaatggttttcccagattgaagggttcaaatctttgcacctagcagcaagcgagagaatgagattatctctgtcttcctccacggattaaaaacagtgataggataatggttggacccagcactgtaggcctggatcttggggcttcttgggaagaggaaggatacaattaaagataaggaactacaaaaccccgtagggcgcttggcgagtgaccgggctgggtgttggcagagagcaccatgtgtgtaagcccctgtggccacaaaaggaccattgggattcttcacgtggaccagtgttaagcagctggtaaacagggaaaagcatggggggaagtgaacagggatggaaggtttgtcttgattagtattaaaaaaaaatgttttactttctagaaaattgtaactttgaaggggacctcctactaaatttatttttaa

SEQ ID NO: 260706 - DNA, 1412 bp, Homo sapiens
agcaggctggtaccggctctgaggtgtatggatcaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgaaactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 260707 - DNA, 1355 bp, Homo sapiens
agcggggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgaaactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacca

SEQ ID NO: 260708 - DNA, 483 bp, Homo sapiens
gctcttctttgtagaagaactggctagatataggcagggtagaggcaaagtttccaagaggctgtgagcctttcgatgcacctttccagaaatccagccccaggggaaggctttaggagaattgccacagggtttcccaccctcagggctgtcattgctctgggttatcacttcatcaatccattggtcatggttgggataccaggaggtggggtgggaatggtgttcccccttgggctgcagtggtaggttttgttccacagatttggccattgcgtatttggattacttgctgcccctgccacccaccatctatcccagaaattgcattttctgtcttgccctatttgccatctgtaactctcacccaccagaaacttacaaagcttatctctcccaagttcctcttgataagaaatcatgtttatgtgattctagttatttccactttcataaagatataaagtatcattaaaaaaaaaa

SEQ ID NO: 260709 - DNA, 2540 bp, Homo sapiens
cagccaaaccatatcaaccttattgatgtttttgcaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaagg

SEQ ID NO: 260710 - DNA, 2528 bp, Homo sapiens
catttttttattattgccattacaggttttggaaggtgacaatgaaatgtgaagaagttacatttctcaaacttgaaagttagtgacggcttaccaaattttaatgaaaattaaatatgacttagaagcattgatttatgaaggcttatgatgtcatcggtttcgacagaaagcaaactccagcaggctgtgagcctacagggagttgacccagaaacatgcatgattgtatttaaaaaccactgggcacaggttgtgaaaatcttggagaagcacgaccccttgaagaacacccaggcaaaatatgggtctatccctccagatgaggccagtgccgtgcagaattacgtagaacacatgctcttcttgttgattgaagagcaagccaaagatgctgcaatggggccgattctggaatttgtggtctctgagaacatcatggagaaacttttcctttggagcttgagaagggagtttactgatgagactaaaattgagcagctaaagatgtatgagatgttggtcacccagtcgcaccagcctctgctgcaccacaaacccattctgaagcctctgatgatgttgctgagctcttgttcaggaacaaccacccccactgtggaggagaagctggttgtcctactcaatcagctctgttccattcttgccaaagatccatccattttagaactcttcttccacactagtgaagaccaaggcgctgccaacttcctcatcttctcccttctgattcccttcattcaccgagaggggtcagtaggccagcaagctcgggatgcattgctcttcatcatgtctctttctgctgagaacaccatggtggcccatcacatcgtggagaacacctacttttgtccagtacttgcaactgggctcagtggtctctactcttccctgcctacaaagctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataaggtgactgtggaagaggtcatgaccacaactgcatatctggaccttttcctgcgtagcatctccgagccagcactacttgagatcttcctccgttttatcctattgcaccagcacgagaatgtccacatcctagacactctcacgagtcgaatcaacaccccgtttcggctttgtgtggtgtctctggcattattcagaactctcattggtttacattgtgaagatgtgatgttacagctagttctaaggtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaagg

SEQ ID NO: 260711 - DNA, 487 bp, Homo sapiens
catctgctcttctcccttggcacaaagttaaactgcatttttttcagcctccctggaggttaagtgcaaatcagagagatgcatgaaaaagtgatgtttctcatgcatttcagaagaaaccatcaaaacctcccaggtgtgcttcttccggctcttttcccatttgcaactctgcaactcataggctaggaaatgacctcaggaaggactttgaagtcatcagcggaaggtggatgaatgactttgtggaatccaggcctgagcttgattcctttcctggatgaccagaaatatccacaagggactgctaaccttgaacaagataaaactttgttttattccactgagctttggaggcttagcatgttagaatggttagaattggtagtattagagcataaattaatgtggcaaacttactgagtttttgtgaatactgctatgagtgaattgagcaagtgaataaatgtaatctatatttatgaac

SEQ ID NO: 260712 - DNA, 475 bp, Homo sapiens
ctgtattcaacaattggctcatgaaacttctgcaaatttaacaccatgctcttgtgagctggagtgagctggcatgagcacactactgcccgtatttaatgaggttgagatgccacagcttccaaggcatgaggaggaggagggaatctgaagacagacaaataggaatgttgaagtggctgtatcatgctaactgcacactcattcccgactacattcctctagaaagcccacaagatatcttcttcactaagacttcgatttttaaaaattttatttcttgttattttgttttagtttagtagtaccttaggaggaaggcaagggctgaaaaactacctattgagtactgtgctcacgacctgggtgaaggaatcatttgtactccagaccccaatgacatgcaatctacccaagtaacaaacctgcacatgtacctccaaacctaaaataaaagttgaaaatggaaagaaaa

SEQ ID NO: 260713 - DNA, 313 bp, Homo sapiens
agtgggggttggggacccctggtataaaggaaaaataaaaatttgatttgagtaggaagctctggtttaattttggcattatcagctaatggccatgtgactatgagcaactccctctgggaagcagctggactagattctcctaagggggcttccagatactcttcagctgtaatatattatttccatgtggtggcaagtagctgcttagggatttgttttcaggttaattgaagacatacagcaaaaatggttgaggcagactgtagaattctacaggtctgagtttgatcttggccctgccgatgtttca

SEQ ID NO: 260714 - DNA, 343 bp, Homo sapiens
atccaccaccccctgcctgctggggacagcgcagccccatgccacagggttgcgtagggagctggggtgcagaaagagctccgtggctgtgggttttggtcctgggcttcgggacagactgttcagggctggttgggaaggacatagactgagcagaccctgcccacagagggcttttctgtgccagggccacaggggtcccagagacggacacagaggctgccacaggcacccatggctggtagaatgaggcagggactcagagaactggggaactgactcccacctcagtttcagtatcagcaaggcgcccttgaaatctgatccctggcttctgaagccc

SEQ ID NO: 260715 - DNA, 240 bp, Homo sapiens
gatatgtttactttcattcttactaagtagagtactcagaaggtgtgtcttcttctgaggctttcacttggcaaagataaaattagtagtctctaacgtatagctagtagagaccaagcaaaatatgatttgttgtcagttgcatcttttctcttgccagaggcaattgattactgaactcgttataggtttaggagtgttgaagatcatcagtatcataaccaaaaggaaaataatgtg

SEQ ID NO: 260716 - DNA, 455 bp, Homo sapiens
cgtaattgttagaaaattcttaccagtgtcatattgagctgacagtctatttacctttctgtaactatgaaaacattggctctctggaagtaggactaagcctacttcttcttttaagcggtaataaccacttcccttttatagactcccagggttgaaagggaccttccaagtcatctgttcaaacctcccattctggcatggaataaacaggtttttttcctgagtatatactatgtacaacgccctaaacatagataaaagacacagtgttgtgccccagcccaccccccgcccccagccccaaaggtgaggcaaagtagcaaataattacaacatggggctcagacagaagttacatttaagttgatttctaaaataatttgtttccctttttgttctagaatgtttttgttctttcaaatgtttgacataaacttcttttggatattaaa

SEQ ID NO: 260717 - DNA, 456 bp, Homo sapiens
attcacctaaaacatgtttatcgagtggcaccttttgccccagcactctgccacttagacactcaggatgcgtaggtgagttacatgttgcctaagaatctgtttccctgtctgtaaattgggggtgaccccagaagccaatttgcagaactgggggctaaaaataaatgattcctgtgccgtgtctcacacctgtaatcccagcactttgggaggccgaggcaggaggactgcttgaggccaaaagtttgagaccagcttgggcaacatagcgagaccccatctatacagaaataaaaataaattagctgtgggtggtacatgcacctgtagtcccagctactcgggaggctgaggcaagaggatcgctggagcccaggagttggaggccgcagtgagttatgatcacaccactgcactttagcctaggtgacagagtgagatcctcctctctta

SEQ ID NO: 260718 - DNA, 464 bp, Homo sapiens
atcttccattaacattggtgtcctaattctgagcatattgaaaaaagaagcgaaactacacagatccatagaacgggactgaaagggaccttaaggagcatattgtctataacctgcccatttcataaagtcgcctggtgatatcgctagactaaagtagatgagggtttcttttccattcaaaaggacaggaatatggatgaaggtcaatgaggaccacgttagcatattagccagcatgactttgttatacttcagaagaaaactgctgcatctcaatgttacctccacaataaatcaatatattaggttgaaccacatgaaactgcccatacttgatcattttgccctaccaaaaaaagtcaattacatatgattcaacttagtatgttccaaactctgaaactgcttttccagtaagtgaactgattatagtcctttaaaaactaaataaaatgaacaga

SEQ ID NO: 260719 - DNA, 437 bp, Homo sapiens
  misc_feature (13)..(13): n is a, c, g, or t
  misc_feature (15)..(15): n is a, c, g, or t
  misc_feature (37)..(37): n is a, c, g, or t
cctcgtatgcccngntgatctagaggatcccatcganctcaaagtgacagactgaaagggaccttaaggagcatattgtctataacctgcccatttcataaagtcgcctggtgatatcgctagactaaagtagatgagggtttcttttccattcaaaaggacaggaatatggatgaaggtcaatgaggaccacgttagcatattagccagcatgactttgttatacttcagaagaaaactgctgcatctcaatgttacctccacaataaatcaatatattaggttgaaccacatgaaactgcccatacttgatcattttgccctaccaaaaaaagtcaattacatatgattcaacttagtatgttccaaactctgaaactgcttttccagtaagtgaactgattatagtcctttaaaaactaaataaaatgaacaga

SEQ ID NO: 260720 - DNA, 3896 bp, Homo sapiens
  misc_feature (350)..(350): n is a, c, g, or t
  misc_feature (1057)..(1057): n is a, c, g, or t
  misc_feature (1400)..(1400): n is a, c, g, or t
  misc_feature (1746)..(1746): n is a, c, g, or t
  misc_feature (1769)..(1769): n is a, c, g, or t
  misc_feature (2024)..(2024): n is a, c, g, or t
  misc_feature (3891)..(3891): n is a, c, g, or t
gtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcncgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatgggnggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggantggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggngcgggtggaggtgcggctgccangggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccntattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggtgccagccaacagtatgcatctgacttccataacgttttgaaggaggagcaggaggcactgtgcttggatctgtggggcacagagaggcgagaggagaggagggagcctgagccccacagcaggcaaggacaagctctgggggtcaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaanaaaaa

SEQ ID NO: 260721 - DNA, 270 bp, Homo sapiens
gttcttgttaatgccatcagcacaggaaaatgggcagctgggcaagatggggaccccccacccccgacccctggctgctccctgaggggctgaagctctcctagcacacaaatccccagggtctagctgctgagcctcccaggccactccgggccctggcaggccctagagctgtagctgtgaatggtacagctgtgtgtcctttctgtccccccaactgtctactgtgctggagtctccagactgtgggggttagatacatacaataac

SEQ ID NO: 260722 - DNA, 182 bp, Homo sapiens
tggatgtaggatctgttggaaagagtctgggtcatgggggcatatctctcatgaatagctggatgctgtcctcatgataataagtaagctctcactctattagttcccaaaagagctactcgttaaagagcttggcacctctctctctctctctctctctctctctctctgcctgcgcgccc

SEQ ID NO: 260723 - DNA, 235 bp, Homo sapiens
acacatacacacaggcacacggtacccataaacacacagccacacacacattcacaggcacacacacattcacagggactcaataaaccctggaatcttctctgtgatagttaataaagcctaccatatgaatgtgtatatgtgtgtgaaatgtgatgtttatagtagatgtcaatctacttctatgtgtttttatataaatgagaataaaacattttaatcccctttaactttg

SEQ ID NO: 260724 - DNA, 437 bp, Homo sapiens
gagacctctcctcatctctgcagggatgaggggccaactctgtagcccaggctgttgcttcccggtctgttgatgaatcctccatagtctggtgagtgtagtgtctgactctggagcccaggctattgcttctctgtctggtgatgcttcctccatactctgtagtctgctgtgtgtaaacatatgtatatatatatatacatatatatgtatataatttatacatataactgtaaataaaaataattgtataatgtacataattatttaaataaataaatgtaaataaatacatatataattttatatatattatatatatttatatatataaaaaatatatatattttttcccttctcatatcaatttgcttatcatatcatttacttattatatctgtattgccatataattgagacaaaagatgtttaccctt

SEQ ID NO: 260725 - DNA, 457 bp, Homo sapiens
tttttttttttggtgttatacaaagagaaaatgttcttaattctaatacagtcctattcatcaatctatttattttatgatttgcacattttatgtcctgagcatatatgactacctccaagatcataaacatcatttcctatatattcttctagaagttttatagttttagatttaggtatgagtatattatccatgttgaattgatatgtatggcattatttaaggattgagttttattttcaggtggatattcagttgttccagtaacatttgatagaaaggcttatgatttccaattgagtaactttggcatctttttggaaaatcaattgcacatacatatatacatctattccgggaatctttttctgtgcccttgtcaatgcttgtttcaataaacacttttttgcttggtgtagttttataataagtcttaaagttaagtagtgtgact

SEQ ID NO: 260726 - DNA, 353 bp, Homo sapiens
gagctgatattatgatgataattatagtaaagctgtgtcatattcttttggataaagtcattttaacgatatattttaacttcctttagcgctttgtgtgctgacataatcaggaattgcatggagttacaacttttctttctctcacaatctccatttgaagaaatcattttttaatgtgctgtgtgtgtgcatgtataggcatgtgtgtatatgtgtataataagagaaatagggttgggacatgtcttgataatctcaaatttctaaccatcctgctcctttttttgttgtatttgtaatattcttctaatgttattaataaaaataaaactgtttcccattcagagttt

SEQ ID NO: 260727 - DNA, 1445 bp, Homo sapiens
agacctagaaatagcaactaaagagggatgagaaaaaaatatcataaaggtcaagggaagagtgcgtcttgagaaagaggatatgtccatgtattgccaaagcttaaggatattttctcttttcagaatatggcaacagatttctgaaagtaaatgtttcccatttcctaagtaccatacctaccaaaagacatcagaaatatagtcagatcttactgatcaacttctccatccaagtgatcactgttacttaagggctttcaatttttttttttgaccatgatccacagggaaaagaaaaatacattttatattgtgattcagctcacaaaatataaaactatctaacatattaaaacaaaaattgtacaagaaaatatttaaactttaccacatgccttgcattcagttatttttcattccagtccattccacaccattccattcctttccattaaaaataatatccctcaacattcatttcatgagtcatcaaagagtcctgaattgtggcttgaagactattgccattgcctatgtggcccctccctcctcaaacttcctcactctgccaaaggcaaggcagcttcccatgacagatgctgatgcaggagaaaaggctctttacaagattttcaacaaaataaatgaatgatgaccagaatcactcagcaaatattccagtaatgacactcacgcatggcaaacagccatatggggccctcagtggtctctgatttacaagctttatctcactaattatcataacaaccctagggggtaggtactcttattttcatcccattttacagatgagacagctgaggctcagggagattaagggatccactcaaattcacatgactagtaaacagcattcctgggatttgaaccactcttccctgacgccaaaacttctgtttttagtgctacattctatttttttgcattaattgttttggtggatagaatttaaacttttggaaaattttcaccttggaaacaaacttcactcaaaagtataaaagtataatctgtaaccttcccagctaggttcatagcctggctatgaactggggactgtctgactccagagctgagcttggagccctctggcagtgaaatacattgtcttatattcctgtccctctttcacatgcacaggcatgtaagaactccaacatcgcaagcttctttttaaaaacatatttttaaaagttgcacaatctgagtgatctgctcacacgaagcagtgatgactcttgtctattttttaaaaatccctttctggatcacataaaacataaaggacagagcaagctctttgctccacctaatggataaggaggcaaggacatgctcacgagccttttctctgcaaagtgatttctttcctctaacactggctcctgagaaactccttggaaatgagaatgaggttctag

SEQ ID NO: 260728 - DNA, 605 bp, Homo sapiens
gctcattgcttgttattatatgtgatggatataaatatacatttataaataaatctgtccatccatatatacaatgatagattaataaacacagtgctggtgtgttcatttacagctcagataaataaattcaattttttagtggcaaacataccatatagattaaaggaacaaccccagtttcctttgacagacctgctttccaagctttgtggccataagatgctttgcagttgaagcatatatcccaaggagattaaataaattcttgtagttagcagttggagagcgtattgcttcttttctgtgaacactgaagaaaggaatattttatgatgagaatcacaaactgtataagtttaagctgaaataaggctcttggcccactagctatttctctaactttgctgtttgttctgtgtgctcttgtggtctcaataccttgaattcttaagaaactaagatttacaaggatcatttcttcatgtgaagaaatgaactcttttagttcattttctgttgcttataacaaaatacctgaaactgagtaatttcttacaatcatggaggctgggaaggccaaggtcaaggggtggcatctggtg

SEQ ID NO: 260729 - DNA, 402 bp, Homo sapiens
ggccctatggcccgccggcttttagctatgcgccggtcccacagctgcagtgctccctcagtccctggagttcccagccaagccacagacctgcctctgaggaagggaatcgagcagggagtaggaggggacctctggggactcgggcctggtaagtggggctctggcaggcagaacggggctggggtgtcagcaccaccccgcccattcctctctgctttggtcacagcatccctggtctccaccttgctcactggcttctcgtttgggctggaatgggcctctgactcctgtctgccccagcctccttcccgtactcccgggttctcccttttccttgttccctaaagccagtgctaattaagacacaccctctttgcatgttccttccaccattatccc

SEQ ID NO: 260730 - DNA, 662 bp, Homo sapiens
atagagaagaggtctgggttgaaggtagggatatgtgtgtcatctgtgtgagcctttaccacttattgttttgtttcatttgctttcgcttttgcttctcctctgaccctgcacctgtgcaacttcccctcctccgtcaggtctcagctccaatgttgcttccttcgggaggccgccctactcctaccccagtgtgaattaggccgagttaggctctcccccagtctttctgtttaaatttttccttccaagcacttatcatggtttgagatgaaagatttatgtttgcctgtcctttagcgatgaatcccagtccacactgaaatgtgttagaaaaaaatgacttcatttttctgtaatgaaatcatttaggccctaaatctgaggaagagaaggcaggaagaagagctgagtgcagataaattgcaacatttatggatcagatagaaaaagagacactgccgcaagcagctaagaaggagctagaaaggaaacagggtgtccgggatgccatgggagagggagatgggagcgtttcaggacagagcacgtgtcgctgtgtctgattccgttgaggagtcaagcgtgtaaagactggagtgtctactggatttacaatacggggacacaggtccttggttccagcagtttgtgtggagcag

SEQ ID NO: 260731 - DNA, 430 bp, Homo sapiens
cttatcactcatcattaacatgtactctttggagcaagggaaaaatgggaaagctgtatgaagaaaaaggcatacatccatgactactacaccaaatcatgtggccaattaattgcattgataaaaatgtcatcaaacgtggagacataaagcctgcatgtttccatgaacagtgtcaactaaaggaaattatgtcacatattaaaataagacaagtaaatatataaaaagttgaaatttttttaactaatatctgagttcctctaaatactttctgtaatacatgaaacagaaagtttgtagttttttgcttggaggaagaaacaatattgtcttaccactcatttgatattttctcaggaagagtgtgctttcccctggacagtcagaagcaaaatctgtagaggaagaaggaaaaatgtgataattt

SEQ ID NO: 260732 - DNA, 554 bp, Homo sapiens
ttacgcataattacagcagcaagatgaaccgggtaacattcaggctttaattaaaaaattgagctttaccacttgagaaaattgcttaagcctgtggtctcaggtttctcatctgtaaaaggagggtaacaacagtacctatctcatggttatcatgaagcttaaacgaaggaactgagtggttaggcaagcgccagaaatttagcatgcacacaataaaccttagcaataaaccactatcatttagaatgattgaatgttaaacattgtacagggccataaaactggactaattaaactctttggcaatgtagaaactggagcccacagatcagaatcccttgattcctaccctatgtcactgctccttccactacaccactatataaaccttcttagactgctttatgttcgaaaaatagcaggatctcccagcagtgctaaccaggagcaggaagtaaacaaaaagtttctatatcggggtgggcgggggagaaacaggaaatgggcgactgcgcacactaaaattgagatcccttggagcaaggctatta

SEQ ID NO: 260733 - DNA, 543 bp, Homo sapiens
tcactcatttgagattcagaaaacgaaggagcaagtcgtgtaggggagaaattaagggttctttttagacatgttaagtttgagatggctaagacactctaagtaaatttttttttaggaagcagttggatatgcatttttggagctcagggaagatgtctgggctagcaatacaaatttggaagtcatcagcttgtaaatgatatttatagacatgagaatggatttcttaaagagaatatataaatttgagtagtggaagagtgattcagtgttggaggcaaatctgtttcaagaaaggagtggttagctctattgaatgtgctttgagagactgagggcattaagtttgtatgaagagagtagaaatagtatgattgataatttatgagattatggggcattgctacattgacatcttcatcagtgtgtccttttgctttaattcatttaatattttcttcgtgataaaactctttgaagtgggaattacttgataaaaatgtatagatattattcatggttctttctccatactcaacc

SEQ ID NO: 260734 - DNA, 953 bp, Homo sapiens
tcttctgcctccttttttccactttgaaggacccttgtaattatattgggcccacctggaaactcaggatactcagtctattttgaggtgagctgattagcaatctagttctgtctgctatcttaatttccttttcccatataacctgagattctacggattcaaatatagacatttttggatgtccgttattctacagagatcagtccaaaaggcaacaggaatatgtagcaattctaattttatattcaaaatataatcaagtggaagtttaccgaactaaaaggagaaaagagtcatctataatcatactggaagacataatacacctctcattagctgatggcatgaacagacaatatcacaaagaacatagcaaaggtgacagacttgatctaattgggatacataaaacactaaccaacaatgacaaaatataatttcattttatgctgtataaaccatttaccaaaattgaacacataaaggaccataaagccctaatacattacaaagagtagaaatcaaaatgagtgcattctctgaaaacagtgggattaagctagaaatcaataaagccatagagattactaggaaatctctaactgcttaggaattatgtagttgtctgggcatagtggctcacacctgtaatcccagcactttgtgaggctgaggcaggaagatcgctcgagcccaggaattcaagaccatcctgggcaacatagacccctgtctctacaaaagtataattttaaaaagtcagctgggcatggtggtgcatgtctgtggtccttgctacttgagaggctgaggcaggcggatcgcttgagcttgggaggtcaaagctgcagtgggccatgattatgccgctgcactccagcctggataacagagtaagaccatctctcaaagaaagaaattatgtagtatacttctcaatgacctgagag

SEQ ID NO: 260735 - DNA, 236 bp, Homo sapiens
tcagtagcttgaggatgtgactttattttcttctggcttgcctaaagcctaataagaagtctgctatcattcttgttggtgaacgtcagagaaacatgtgtcctttttttcttttatttcttggttgttttcacaatgttctatctctgtttttcagcaacttgattatgatgtacttgagtttatttttctatatttattctgtgtggagtatattgagcttcttgggtctgtag

SEQ ID NO: 260736 - DNA, 372 bp, Homo sapiens
agagtgaatgttcgctggggccttccagaagacagttcagtcttagcaaactggccaggaaggattttcatcaagatggaggaaaaacctggagatctttggctcaaaggacatgacctaattctacagatgaatctgtactgacgttagaaaaccactggtggaacataaaacttgtacattcttctaaaaatgaaggtagatcacagcagactcaatctatttatagccagtcatatcaacattactgattgggaattaccaaaagaggtgaaattatttaacaaatcctttgttaagtcatattctgaacctacagatgtcaatttcaggtgtttattttttaaataaagataattaaaacactaaaaa

SEQ ID NO: 260737 - DNA, 109 bp, Homo sapiens
gaataagtctatgccgtctattctgactggaattaaaaattaacctttaaagtcaattcaggttaagcacagcacaaaagcatatcacttgctaaatggtatttgatga

SEQ ID NO: 260738 - DNA, 452 bp, Homo sapiens
cagctgaatttcctaaaatacagggtgcttgatcataagactcttcaagaaaaagatattttagaacactaataaatacaatgcgaaaaaactgtgttcttatctgggtccttctatcagtgaagccaaaagagctattacaagacaacttaaaactcattccaaagatgaaggcagttgtctgtacaatgcagtgcatcccaggcatctccaaaagacagtaatgagaatccaacccgacagtgaagggagccatgcccatcagggaagttggtgcaattggaaggaaggaaggaaagaagaggtgatccaatcagcatattttttctttgagaacatgaataacaatattcatcaatttctcatacccacaaaaatgttctaaaaaaaacagagaaagcaagttagaaaatccgcaaccatagcaagcagtatcctaaagaaacataatt

SEQ ID NO: 260739 - DNA, 388 bp, Homo sapiens
ggttgcatgaggggccagccaggctggggggtgctcagctgaccagactgcccactgaccttccttctcctgtggacagaagcagcccccaccccttctccagataacaaacacacaggtgtgcactcccattgcacccatcaaagataattgccttattttgctagtaaaattgctgaaaggcttgtcaccattttgcctgtgaaatcagtcaagtacgaatcatccatccaatttctagtaggtcctggtttctcacacttgaactgcctactcaggaattctgggcaaataagaaagatcaaagcaacaaaacctgttcacacgttactgtccttcctgtgactgctaaatagagcaattaataaagttgtcacaatgttacagt

SEQ ID NO: 260740 - DNA, 566 bp, Homo sapiens
gaacttagaccttctggcttctcctttggggatactcctccctctaggacaagtgttgggtctgttctttagccacacactttgtgccatgcctcatcctttaggagaaagaatccagtgggggctgggagtgagtgggcaaggctgtttgatgattaggtgaggtgttagctcacccacctgatccagatctgaagtcaggttttcaagtgtttattagtgatgctaactccagcactgtcatttcacccttgctcagttgtcccttcttcactgtccttgactgccccttttcttggaccccatcagtaggaagttggggtcaactcagtgttgacaggttcattttggccctgagctggttcaggactacatcccagcctgtcccagcaccttgcaaataatgggcactagatacacttgttgagttgtatggaatggaattgatgtataaatatttagttgcacataaacatcctggaaaaattagttgtgaatcacaaagaatgattctggtatctttggaggatctattgagaataaaagtaaaaactagagacaggaaa

SEQ ID NO: 260741 - DNA, 696 bp, Homo sapiens
cccttagcaacagtccatgcataattgcttggagttttaaatgctaaagaaaaatggtgaatttgcactcactaggttttgtagtgaattcttgacatgcatagccaatgcaccatcaggctaaatagtactcatgaagaaacagagataagacacttctggaagtgtgaaaattctgatttgagagaaatgtatgcagaattgatatttatagtacttattttctggctctaatatgttatatattctgctcttggatattggctaattatcatgtcagtaaatgctgtatctggaaaacattttgtcaagtgaataagacttttcatatttctggtaaaagaacagtatatatacttttatacatgtttccaaagatcaaacagctttaaaaaggtgtacatctggctattatttaaccagactgaataatgcatgaaagaatgtagactctttggaataatgtgttattttaattcttacatgactctgttacagagcaagtttatttccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagt

SEQ ID NO: 260742 - DNA, 1044 bp, Homo sapiens
gattagaaaaaaaaaaaaaaaaaaaagtgaatgctccttcaatatttatttcatagatctgtgaaaccatttatcaaatcataggtattattcatctttggatccagcttgcagcactttctaacgatgcccatagagtgtttttataattgaaaccatcatgtttgaactagaagggggatgatagaaattaggttgattaaaaaaattattcagctctctttatcctctcaaaatttatagcctctagatgaaaaggagaaaatagggtatcagatgtattctagaaatgcttgatacctcagctgaaaagtaccatttgccacttccttcaagatagtatttgttttgtattacccatataatatttttaaaagttaaaaacacttttctgaataggtaatgtattcatcactgtgtaaaattcaaaaagtacaaaaacgagaattctgtgaaaagtattattctaagtcttattccctagctacttggctcccctctgggaggcagccggtgagctgtatgtttcttttgtaccttttgaaatgattgtatgtgtatacaaatgatcactttatgtatacatttctcctgtccccccccccccttttttttttttgcatttggcagcataccttaacatactcttttgcatcttactttttttttctcaccacttaacaatatatgctcatgcacttcataacaatgttgcagtcaacagtagaccacatatacaaaagttgtcccataagattttaacggagaggcggagcacagtggttaacccctgtaattccagcactttgggaggccgagacaggcagatcatgaggtcaggagttcgagtccaccctggccaacatggtgaacgtctctactaaaaatacaaaaattagccgagtgtggtggtaggtgcctgtaatcccagctacttggaggctgaggcagaagaatcacttgaacctgggaggcagagtttgcagtgagctgagatgaccaccactgcactccagcctgggcaacagagcaagactccatccc

SEQ ID NO: 260743 - DNA, 550 bp, Homo sapiens
tatgaaactttcagagtagcaggggagtcttaagggactaaagcaggaggaaacacaactgaaaatgacaaggggaaatcttaccagcatgaaagcaaagttctgcgtttaagtttaaaggaagatgaaccctgtgaagccaggacacactgcggggaaggggacaagaatgcaattgaaagcccctaacggagaaaaaaaaaagcccatatgtttgttttgttttgttttgtttttgagacagagtctcgctctgtcgccaggctggagtgcagtggcgctatctcagctcactgcaccctccacctccctggttcaaacgtttctcttgcctcagcctcctgagacgctgggattacgggcatgcatcaccatgcccggctaatttctgtatttttagtagagacagggtttcaccatgttggccagtatggtctgaatttcctgacctcatgatctgcctgcttcagcctcccaaagtgctaggattacaggcgtgagccaccacgcccggcccaaaaaacccatatgtttagcatacgctaaaaac

SEQ ID NO: 260744 - DNA, 99 bp, Homo sapiens
gcttacaggtggctttttgctgtgcgcagccttttcttcaaggcaggttggttcctgtatcttgtcttaatctgttactcaacgaatgtaatctccatt

SEQ ID NO: 260745 - DNA, 431 bp, Homo sapiens
gtatttacttctttcaggtaggcagttttgaaatagatagaacatgcaaaatacaggtcaggggccaaacttatcattcagtcaatggctgctattagttcccatataaatggagaagtaacgcatttgaagaatcttctataagtgcataatggatcagacatttttaaaaagtcactgtgtgaaggagtttggacccagttaacacactcgcatgctttgtatagaggtgcttctttataacagctttttcattaccagaaatcaacttctttgatgcacgcaaactttattcattttgtcactaatattattatttataaagaaaaccctttcatggataaataatgaagaaaaagtcttacaaaacaaataaacaagcaagcattcaagtagaattaattaattatcaaaaaaccccaaaaaaacaa

SEQ ID NO: 260746 - DNA, 391 bp, Homo sapiens
ctgtgcagaaattatctaattccataacaacttatgaggtaggtattattatccccatttcacagatgagaaaaatatgatgtctggtgttaagtaatgttctctccatcactaaggctgaggttcaaatctgatgaatgtctgtgtgcttaatcatatctctacactggaggtcgaaaatgatctatgggcacatgggtaaaaatagtcataatgatctagtaaaacagatccatttaaagtaaaagggaggagtaaggattgtagcaaatgcaaactgaagagcccagacccaactaaaagggatagctttgtgacctgaggaaatgtggtctgttgaggctagaacttggagttgtttttcaagagaacctggaaatgtggaatttta

SEQ ID NO: 260747 - DNA, 395 bp, Homo sapiens
tgcccagactggagtgcagtggcagaatctcagttcactgcaacctctgcccacgggttcaagagagcttcctgcctcagcctcccgagtagctgagattacaggcacttaagtattttatttaaaagccacacttttaagaagacccaagctcaagccctggctgcaccatgtaccatccttgcaaccctgagcaagttgtttcgccaccccaaatctggttcttttcttgctagatagaagccctgatattgcccatttcacacagtggtcctgagactccaatgagagataatgtggaagcatcttgtagactaaaatgttaataaaaatgttaactaaaatgttaaatcaaaaagaaatgcgggaaataaatgttgtatttgtctaaaaga

SEQ ID NO: 260748 - DNA, 273 bp, Homo sapiens
taatgtaagcgtaactacgaagccacatgggagaggattttgaagaggttaaaatttggggtcaggaactagatttcagtcctgctttcaccgtttactgtgccttggattttaaagaggatcaaatgaggttgtgaaagtactttgtgaattcagaaaaccccttggaaatgcaaaaatgttggcacccccacccatccttccgtccctaaccacaatctccatagatggaatatatgtacattatacgtaatgtttacatattgtatatgc

SEQ ID NO: 260749 - DNA, 120 bp, Homo sapiens
aggggcacaaggagagtgggtaactctctccctgactacgtgacttgtgcttttatttgaaatatcttgaatttctagaaataccttgaatatcttgaatattcaaatgtttaagaatga

SEQ ID NO: 260750 - DNA, 448 bp, Homo sapiens
aagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagaga

SEQ ID NO: 260751 - DNA, 346 bp, Homo sapiens
caggcacaaaaaaatcagatattagggaattctggtccaaagaagagtccagaaaaggatgaaaagaaaaagtaaaaaacagagagaggtgtgcatttttaaaaccattacatcaaaacaccttacctctggctcatttttgtagatattgcaaatttggccatttatattactgtttgaaatcatttttgactataataaaaatagcattccctgcattaataaatgtttcagtttattagcattaagtttacatccatggttccttcaggcacaaaacattaggaaatttttgtcatttcataacacctttattttattaagagatgcctccactttagcagta

SEQ ID NO: 260752 - DNA, 224 bp, Homo sapiens
aattcccacttatttgcaagtcatcccttattttttggtactctttttattctaaggctagaaatccgtttctaaggacaagtatagaaaattttaagccagccatggtggctcacacctgtaatctcagcactttgggaggccgaggtggaaggaactcttgagcccaggagtttgagactagcctgggcaacatggcaagaccccatctctttaaaaaaaaa

SEQ ID NO: 260753 - DNA, 691 bp, Homo sapiens
gggacactgactttgagtccaacttttgatttatgtcataattggtgcccatattcatgtaggtgggaactaaatatacaatattacccatagtcagacaaaatatagatttagacagagcctggcttacaggtagaagaattggatgagaaattgtgatgggcatttggtgttcaactcacaggtagagtacagtggatgggtttaatactatgaaaacaactggtcagcttcgtcagctctaaggacagaatgaaaggcagagtggcttggatgactcattctgagaggatgcctagtgaagggctctttcacctattgtgtgccacagacttctttgtcagtttgatgaagacattggacctattccaagattaattacttaatgcataaattaaaaatccagaatttagacttccatgtctgggaagatgaaatagagtgctttttcctctttttcccactaagtttaactaaaaaccttagacattacatgtacaacaaacagaagactctgaaagttgtagagaggagggcagataggttagtaaccttaagactgatacagtggtgagttcccagggtttgttagtttgttgtatcattcatctcatacttgtaggtgaagaagccagcaacttaaaagcaacttaaaaataccaacgggtggccgggcacggtggctcatgct

SEQ ID NO: 260754 - DNA, 311 bp, Homo sapiens
ctcccaaggggccatggggatttcgggtgttactaagctctggggcccgtctcgttccctgtgcagccttttggctcttccatcgtctgtagaactgaaacagcgcatccaactccctaaagtgggttatggtttcctgatgcgaagctgcctgatagaaagtcgcaggacacttagcagctcctgccctcggcccacccccccgccacgcctcgccgttcctgtttgttgtggggtctcacccactccctgggaagcccccagtagcctttctgctccggggtccctccaggcttcttttctacagctcc

SEQ ID NO: 260755 - DNA, 522 bp, Homo sapiens
cagcagagtgaaactctgtctcaaaataaataaataaataaaaatttaaaagttaattacctcagatttcttggtgacttatactgctttattttatgttctgattggtagtattatatttaagtgaaattgtttgtttctaagtaaatggttttaagatgttatcaaaatttactcaccttttagttaaatcttaataatttttagatgtatatttgtaattcagaaagatcatcttcttttgagaaaagtatagtgttacagtttctgtgcaaaaaaattgatagtaacatttccttttattggaatgtattaaaactttgtttccttgtttggggagaaaccattttgctttatttcattactgttaatacctgtgtatgtattaaaactagtataggctaggggcagtgactcatgccagtaatcccaacactttgggaggatgaggcaagaggatcacctgagcccaggagttcaagaccagcctgggtaacacagggagaccccatctctacatac

SEQ ID NO: 260756 - DNA, 533 bp, Homo sapiens
gtgaatgccaaaattacttaatagcataaaatgtttccttttagcagtagcctttggctgtttctctcttaagactggttcatttatttcatacaacttgaataatttctgaggttacagattttaactgtaattaagtctttcttaaaattggttttgtcagtgtagatacttgtggtagataatcgttttattttgaacttttatatttagaggattgaatattttaattgtcttcatctctatcttctattctgcccttttaaagctagtttatggctgggcgcggtaggtcatgcctataatcccagcacttagggaggccgaggtgggtggatcgcctgagctcaggagttagagaccatcctgggcaacatggcggaaccctccctctactaaaaatacaaaaaattagctgggcgtggtagtgtgtgcctgtagtcccagctacttgggaggctgaggcaggagaatcgcttgagccccggaggtggaggttgcagtcttaccactgcactctggcttgggctaca

SEQ ID NO: 260757 - DNA, 253 bp, Homo sapiens
aaagagaaaaagggaagaagaaagaaacatgcacacatcagaaaaaaatcagaaagggagactagagagacaaaagcaaagagaccatttgaatgatttcaccctgaattattagataacttaaaatggtaaggaactgttaattctggacagtgacaaaggcaaacatttaatggaacttactagggatacagcctctgcaatgatgtgctatttcatcctttcccgcttagcaggaaagagcccaaaccac

SEQ ID NO: 260758 - DNA, 722 bp, Homo sapiens
tggaatagctctcttgaagtatttattgagaggcactgggtaagaaccaaccttaccactaagcccacctgcaccagtcagtataagaagactgggaggggtgaaccttctggggagtgctttttcagagctgagctatcccctttcctcccatgagggagaagacctcaggtgttagagcagctccacttgtaggcatctggggagtggccaaggtgcaggagctggaccaatgtgtaggagtaggagtttgaagcactcaacttgaggaaaggcaaaagaatcatcgccaccccctggaagggtagcagagagggtgctgccttcagaaaaccccactcctcacctgggcagatttcttggtcaagactatactgactcagcataaaaccttgaacaccttttattcgccaggcacataaaaagaatcttttgagtgttgataatggggtaggttgtgtgtttgttgtatggtgaggttgggggacagaggacatataagaactctgtactttttgatcaattgtgctgtaaaactaaaactctaaaaaataaagtctattaaaaatggaactttatctaacaaggaggctccccatctctcagcctggcaaattgggtaaagagtcaagacccactggtgtgctgtattcaggagacccatctcaaatgcaaagacaaacataggctcaaaataaagggatggaggaagatctaccaag

SEQ ID NO: 260759 - DNA, 683 bp, Homo sapiens
acatggggagggtatgtggggggcaggggaagctggttcagaaacaaaagggctggcttccgccttcttcagccacacagatctcttggtccccctctacttctgtctgcctctcatattctgtctgtctctcttttttatgtctatctctgtcatttttctgctcacttctgtttcttatctctgtgtttcatggctctcatctcctactgtttcttgcctttctctctgacctctctgttgcccatctttcttgtctctgtttctcatttgtttctccatctctctgtctctgtgttttcccattctttttccagtctctctgcttctcaaagctcttttggtctttcctctccccatgtcttttatttctcctttcttctttctttcccatctctctttttgaccttcatttcttttctccacattttctccttcacccttttctttgtctcttatctccctttttctgtaccttttattgctctttgtctgcctgcactccaccccttaccctgtgcagcctgtgaagtgaaaggatcagcagacgagaaggatagagacacaagtcccttctttcctctggtcagaccacttgcgcacactcctctttatccttcattcttgtacctacacaagctacaggtagagctgaggaagcctcccccaagtgaggcttctgc

SEQ ID NO: 260760 - DNA, 301 bp, Homo sapiens
gcatggaaagggcttatccacccaggtgcggggagagcaggcagccaactgacttttctaccaggagacgccctccatggcagcatctacggatctttaccctgggcccatgcagtttctccagtttaaaaaaaatctccactctttcccgacctggtgatgagaccccaccatgcatgcctgccagtgtccagggcatggggctgaggcagggcgagggctccactgctgagcaggtgggccgccactctaggataaggatgaagggggatgagcttgaccaaagccccaggggatttca

SEQ ID NO: 260761 - DNA, 2164 bp, Homo sapiens
  misc_feature (1524)..(1524): n is a, c, g, or t
tagcattcagtaaatttcacaacacctttctgcctccctcttccctctcccctctccccttctccccacctcaccccacctcaccccctccctcttccttcctcttttccttccctcctcctttctttttaccctctcctgcccctgacccggtacctataccacttggattatttacagcaaatcttacagatgtcagtattgtcttgttctgaagctaaaaaggacaatgagttcccgctgacctcggtacaatggatctcgctggagcacaatatgtattttatacaggcagtgaaaagcctacaagtaattgagagagagagaaatgtcactgtagcatttctgttgacactgcactctgcgtgtggagggaagcccggggcctggcggcagaggagcagccgcggccgcgctgtgcacccaggaacctgtccttcaggaaggaggcggcggtagaaattaatctgctcagattttccaactaatgaagtattcccaggaccgaaggggccacacagagacgtctgcggcgctgcttcccattcgcgcagatgcacacggattccgggcccagcgctaactcggatgtgttttccagctccgtttattgtcttccataatgcttaacgtactgtttgtatatgttgtccttgcactatattttgatatgctctcatatattttattcatctctggctttctacgaaggcaagctcgcagcaacactgagaataattattctccgccatcaatcaagagtctccgtggttggctcctcatgggatggccttgattttaagcatgaaatgtaactcttgctctttggggccatttcattctttgttcctggggcctgcctgtgggctcgtcgggacactagagagcaggcattcccgtggccgcgggagagccgcgttcctggctggccattcccgggccctctagaagggagcggctgagagctctttagccctacttggggtttaaaagtgaaaaaggagcagctcttcctggtggaaattgcgagcagaggctgcgtgagttccgtaactcgcacacagcctccatttggagccagaatgagcacgtgagggaccccgggcagaggggccagtgctgacattatgctccatgcaacctcccatcctgttgtgggagatggtgcagaccaggggagggagtcagtgtgtgaggggatgaggctccagtcctttcctgggcaccaaagccaaatcccccctgagcacaaggatcttccctgggtgactgcagaagcaaggagacctggcccaccgtccctgctggcttcctactgcccagccgcgtctctgcctccctaccccaaagcctgcagctcctaagtgcactatttgggctgtcttgtttgcagcggatgtttgaaagacagaccctcttctctagtgctggccttgagtcctcagagagctgctgtttcctgggtttctagctccatggaggcagaaagagaccccagggtggcctttggaggaagatgagccncctgggttaaccgagcttctgcagtggtgctcctgggtcatcactgttgccactggtcagagccagagtgtgtctgcctgtgctctcctgaacacagtggagctatttccaagttcaggtgaaggggacatggaggttaagcaaggccagaaagacagagacgtcctcttcccctggtagcaggtatttagcagatgggaaaatattagcagatgggaaatcagcagatacactcagctcaagatgcaaatttaaaagccgccagcccctgtactaaatatttacactgaacatctctactccatcatccgtcttttatttttgtgagcccgtacaactgctcttattacaaagtcatgtaaaagttgaggaaagaaaatttcacccttggaaacaaattcatgatgaattaaatttcagcatgaaaatagaaaaaaaaaattcaaatttctgttgacttttgggcttatgtcctgaaagagttaacatacattcttccatacataacttattcacgtaaattaaatggtacacccccaaaacttgtttccctaagctgatattgaaacttccattattgaacagtttttaaaaatgcaattctaatccctttttaagtttcaataccaaaaaaaaaaaa

SEQ ID NO: 260762 - DNA, 489 bp, Homo sapiens
tatctgtgaactcactgagaagttgaaaagcactttctacccctgaggaagcaactgcagaggcattgccatggtgtattttagatttgtttgacctcgagggagttgtcctagcccacactgtgtttctccttcagggcatttggttttcctttctgtatttgcctttgctcccacatagattatatatatttaacaaattttgtggtcgggcatggtaactcacgcctgtggtctcagtactttaggagttcgaggcaggtggatcacttgaggccaagagttcaagaccagcatggctgacaatggcaaaaccccatctctactaaaaatacaaaaattagccgagcatggtgatgtatgcctgtaatcccatctactcaggtgcttgaggcaagagaatcgcttgaacccgggaggtagaggttgcaatgagctgaaatcacgccacagcactccagcctgggtgacagaataagtctctgtctc

SEQ ID NO: 260763 - DNA, 972 bp, Homo sapiens
  misc_feature (83)..(83): n is a, c, g, or t
cacggagctgaggaccggccggagctttgcggagggcccggcttggcgggtccgggggggagccgaacccgcggggcaccggntccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggctc

SEQ ID NO: 260764 - DNA, 1097 bp, Homo sapiens
  misc_feature (83)..(83): n is a, c, g, or t
cacggagctgaggaccggccggagctttgcggagggcccggcttggcgggtccgggggggagccgaacccgcggggcaccggntccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagaccgcagcactcacagacatctccctggggtctggctcactgccttatcaggacctctgagttttctgacaaaaaatgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctagttta

SEQ ID NO: 260765 - DNA, 834 bp, Homo sapiens
caactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtgggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgacaaaaaatgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctagttta

SEQ ID NO: 260766 - DNA, 962 bp, Homo sapiens
atgcatttcttcaacagtcttgctaataagaaaatttaattgtatttctctttgctgtgatatccctttcattttttctgtcataacaaatggagattattggtattcttatttaggtttaaacttacttgctagagccttattggcacttgatttgagtggtatttttatatttttattatatttaaatgatagaaaatatttgaagtaagatgaatgaaatttcagattttttgatactgttgtagaatgatcttaaaaaattaaactggtaaatggtgactaaagcataatttaatagactaaaattgtattttaaatgtactgtagtatttttcttagatgaacactagccacaaatagatattagcattgggaatggttgaatatgaattgattaaatgtacctgtgtcagctgcacagtaattaaaggtgcaatattggtttaaaaatgaattttggactattaataatacctatgttttattggaatatttattgagattgaatattttaatgtataagtatgtctttgtattttacatttatatatagaacaaaagtggtttgcagaacagttttattttggctattatcattacctaacagtgcattcatgatggagttcaaaggtacaagtttgttttaggcacaagagcttaaatgttagttttaaaaatgtgtacagattgttgaaaaccagtatgctttaatatggagtttaatatttcatttggataatccagatagcattcatgtcataactgtcacagaagtagaaatggtacctggaactactactcagatgaatttcagtatcttttggattgccgaaggctgtggtgctagagtagacctttactgatggcctagtacagttaactttttctttatggttagacccatatttatgctatttctggaaatagtgtagtgtcaaattattaccctaccacaaagg

SEQ ID NO: 260767 - DNA, 650 bp, Homo sapiens
tccaaatgtggggctttgatttcttacagtagacatgtttaatttctacctggaggctcatagggtcaagtgctcttttggtcacccagaaccaggtacatagtttttttccgttctccttttccagaagtggcagcccttccagaatcctggttttatctagaattatccttctcaacaaggctgttttcttgcccaaatctaaggaaatctgatccccatgggagctgtgctatggtggccattcacatcatattgtagctcctctaggctggtgggtgcttgtagcctctagaaactgtattccatctgagctgtctggagaatttcctctttgttttgagctgttaagtattgacattttttttaacccatattttatccagcagttcaatgtgcttgtgattgagggagaggggtccatattagttcatttaccatattaacaaaatgtttttaaagcttttttgaaaaacttcatttaatccacctaataattatttttttcagatgataattgggggtgtggatatttagaaaagctacttagaaaagttttgtctgttgattttgtattctgtgtatcttgtggaacaaataaaagttcaatttttggggggttggttttctgtatagtcatattgcctgca

SEQ ID NO: 260768 - DNA, 528 bp, Homo sapiens
catctatggttaatgtgcatagagctcacctacttagtgacatgtttcatgttctgtatttcatcaattttaagttatcatttttttcacattgcattagttttcaaattaagaaaaattaaaatatttttgctggccagactacagccattcttgtatttgcctgggcagatgtgaaatagcatgtaactattattattttttcactttctttgaaatatgtgcatcaataattatgtttcattttaaataaatttctatttaattttcatttcattatattaccactagcatgaacacttgggtaaggggagtcatgattgagacaaaatgtttggggcagtactagagcattcttttaagaaatgatgaatcacagacaactttgatattacagaaggcaatgttatatgagaaatgaaataagagtatgtctaatcatgaaggtgctttatatatgaggaaatacaattttaagaaattttactcatatgtcttttaagaaatatcaaagttataaaatgactc

SEQ ID NO: 260769 - DNA, 376 bp, Homo sapiens
agcagtagcttacaataatacttgcttcgcagattgtttgaagattaactgtgagaccatgaagtccttggcacatagtaattgttcagcacatgctggcctctccctttacctttgttgattttttctaatagggcaatcagaggctggttgtcatggggtaggcaaggaagaaaccaagtttacagaagccaagtgacttctcacatcatcagaggaagcccaggattagaactcaaaacatgtgcatttctgtctgttcctgagagctatgtacttggctcagagtcggaggcgacctgtgttcccagagatggaaaaggacctgggacttcctagggcaaagcctcctaagtcttcctgcagcagcaacagc

SEQ ID NO: 260770 - DNA, 478 bp, Homo sapiens
gtccaaagtcgtttccctttaagagctccttttcttttaaagttgaattttaggcagcgaggactcttacactagggggcagacagatactgtacttgctctaatcttaagcaattttttccctcccagcatatgctctgatttagcactgtaaatttttcagaggacctaactctgacagcccctggtgattttcaaagtaccacaagccagtggttaaaaattgcattgacttggaagttcagagggacacaatggaagcccctttccctattcatggagctccagtgtggtggaagagaaaaacacacacggactagattgagggaaaggaggaattcaatgaatcctggaggacggaactggtttctactgagttcagagttaaactcggcatttgctggggtctgtattcatattgtgattcaatctgtaaagaaatacagcccatcaggccactttctgcaagaaaattata

SEQ ID NO: 260771 - DNA, 284 bp, Homo sapiens
ttgcctcttgcctgtggtatctcccctgataagcgttgtggattgttccagaccgtgttgacggggacagcttccttctccgcggctgccggccctgaccctgcagctttcagtctgtgggagtagagtcagctgttgagcagtttactctgtccctgtgtcaatgggattgtgcatgttttggttcctgaggggtcattgatggtgcacttttcttttgttgttagtcaatttaatttgttactaataataaaatctggaacttacctgaccccaaaggccca

SEQ ID NO: 260772 - DNA, 684 bp, Homo sapiens
taattttcatcttattccaaatgtcctgacataaaagtctgttcctgatcaaacttgaataaaatgcttagcatatagtacacatgaaacaaatatcaatttcatggccattgttaccattatttcatgatatcattaatccagtggatagaagctcattccttcagtcaacaattattgatgagcttctgccatataataggtctgaggcccaacagtgaacagacatagaccctgccctcaagaagttgacagtctagaaactgatggatgtctcaaccagcaattacaacatcgtgagatgagtactacaaaaatgctaactagccaagtgctgtggctcacaccttggcctcaactacttaggaggtggaggtggcaggactgcttgagcccaggagatggaagttgaaatgacctatgattgtaccactgcactccagccttggtgacagagtgagactccatctctgaaataaataaattaaataaataaataaataaataaataaagtggtaactgcctgcaggggaaataagggaacacataaaacggacatctaacccgcctgaagaaggaaggaaaggaaagggctatgagaaagaagtaatagcttgaggcaaggcgtggtggctcacacctgtaatcccagcattttgggaggccgaggtgggcggatcatg

SEQ ID NO: 260773 - DNA, 374 bp, Homo sapiens
ctgatgagaattgccaaggcacagcaaagcctgcagcttccatacccgtcatgagagcaaataacttatttgtaaacctaagcacttaattaactaaatggaaagcaaggcagtgagtgattcctgacatggccgaatttaagtcaagctgtgaagctccaggtgcagccagaaatggagatggacaacttgaactgaaccctgagagcttctaaaaaggctttggaccactgcttctcagcagtttttctttttttttttgagacggagtctcactctgtcacccaggctggagtgcagtggcggaagttgcagtgagccgaggtcttgccattgcactccagcctgggcgacaagagcaaaactccatctca

SEQ ID NO: 260774 - DNA, 822 bp, Homo sapiens
ctgatgagaattgccaaggcacagcaaagcctgcagcttccatacccgtcatgagagcaaataacttatttgtaaacctaagcacttaattaactaaatggaaagcaaggcagtgagtgattcctgacatggccgaatttaagtcaagctgtgaagctccaggtgcagccagaaatggagatggacaacttgaactgaaccctgagagcttctaaaaaggctttggaccactgcttctcagcagtttttcttgtaagttattcccattatctcaaagaaaaatttaaaatatggttggagaaaagtatagaactgattatccccattttgagcatagatcatcgtttaaccaacttgctttctaactgccaagaaacttgctttggatggtatttccagacataatgtctatcatagcaaatattgacaattgcattttacaaataatcagtttaatatgctttaatatgcttctatttctgattgctcttgatctcatttaatcttcgaagcaactctatcacgttggtgtgcttattaacattattttacagataaagacgcctgtaagtagcttcctcacagggtatttaaggaacttgtagaaagtccacagctagtagctgggagcccatctcatatcaatacactagcttctccccaaagaactttatatatttaggccattgatttctttttttttttttttgagacggagtctcactctgtcacccaggctggagtgcagtggcggaagttgcagtgagccgaggtcttgccattgcactccagcctgggcgacaagagcaaaactccatctca

SEQ ID NO: 260775 - DNA, 466 bp, Homo sapiens
atgcacatgccacagacaggacagaggctgagacagtgaggggcactcccggcgcagtcctggatatccccaaccggactgcagcaacgaggtcgaatagcagaggggagcgagggaagagctgcgcacagagggcaggggggaattccagcctttagtttcttcccagcagatgggtggggactggggaagcaaagcagggccttggagcacccgccgcctccctcgccgcacgcctgctgacgccaagaccacagacctgtcccgagggcctgattctttcaaaggctgcagtgtttgtgtgtctctttgaaatacaggtgatcactggctgtcacagccaacaagctgttgaaccagcctcagcggatgggaaataaaaggcgctctctctggaggaaggtatatgtgcctgccatgggcacgctcattgttcctgaacactcggtggaggaagccgttctga

SEQ ID NO: 260776 - DNA, 473 bp, Homo sapiens
atgatgtaatgaagcattaatcacagaactaatacatgtacatatttgaggtggctttgccattttatacccataattaaataaaagggcaaaatcccccctgataaataccatgtttatcatggcacataaaactttatggcagaaagccaaggccaattgacatatatatttaaaggtaccatggaaagtaaatgctaactctgaatttaaaacagtgggaagatgattagtaagagttggtttcttgaaaaggaattgttctggtaatagtcatctttaatgacttccacggattattcagtgtttctttagggatatgcataggacactggtgcttcagtagaaaccccagttttggtgtattaaagatacatccattcttgactgatctttaatctagagtgtggttttagccaagtctttgaatctcatttagtcagtaaacatttattaaatattaaccaaatgca

SEQ ID NO: 260777 - DNA, 471 bp, Homo sapiens
tgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtg

SEQ ID NO: 260778 - DNA, 663 bp, Homo sapiens
cattcaaagattgtcattaaacagaaaagaagccatgtagaacgtatgcattgattcttgcggtggaaatccagggaagaaacatatgcagaggcacatagtcaacatgttccttctcctaaatttactgataatacccactttttgagctgggaactaacccctctcatttcatgtggctccagtgtgattaccaatctctttctcctacttttccagccagaagtatgtaacccaaatctgaccaatcaaaacaaccatttgcctagtcagacgataccttcaggaatgggcatgtgacaaaatctgggccaagcagagtcttccctggcatttctctatcagtgctctgagaaaagatgcttttttcttaactgcattgctaagcagtagaatatgagtcttgggttaagagcagccatcatggctatcacttgtaaacagcttaagaaacagtggagatctcagatgtttctaaagctacattgccttaggacttttcagtgctatgagcaaatgcatgcccctttacacttagttagtttaagtagagtatctaacataagtacaaatcaatttattatcatagaaagcagaagagttcacaaaatagtgccctagagccttagaaaaatgaaagatggcatggactttctgaagcta

SEQ ID NO: 260779 - DNA, 321 bp, Homo sapiens
aaagatttaagaaatattacagctctagaaactatagaatatagcaagaaaatggaagagtcaaggataccatgaaattcggtgacttgaatattgtaagatttggtgactaccctaacagaggcagctggcagcgaagagaagtaagtagattatattttatgaatgagatctgagtcaataccattgtaggaagtccagtgattttatatttttgttaaacttgcttatgcaatcaaagttctggctatttatatacagtgtaacatatggtatctgcaaggcttctaagcaataaaaactccaaaattccaaagatga

SEQ ID NO: 260780 - DNA, 281 bp, Homo sapiens
gctactatttattggtcatttgatgccagatactgaactaaatgcttcacatatgtcataaagtattatccataatacacctggaaaagtatcattatcttcatctaacacaaatggaaacaaaggctcagagaagttaaacaactgttcaaggttgctttttctaatgaatagcttgtgctcttgttataatatcaagtggcctccgtccattatatgcaacagttttggctctaatttttatcttagatgtgaatacaacataatgaatatataatgaa

SEQ ID NO: 260781 - DNA, 419 bp, Homo sapiens
tttgattttctaccattttattttagtgtccctagatttgctttgttttcatatttatattgaggagtttacagagcttcttgaatctgtgggttgaaacatagctgcttttgaaattctcggcctgtatttcatcagacatttttcttctgtctcaatttctctgcaactccacttgcgggtatgtttgacctctgctatgtctttacatctcatacgctcttctataattttctccctatttgtgttccaatctgctctttattaccgacctaatttcccgttcaatgtttctcactggtagtatttacacctgattttttcaatttcaggtatactataatatttgcaatcttttcttctattttcttatatttattaacaggttatttttctttgatcattacgatgtcttgata

SEQ ID NO: 260782 - DNA, 355 bp, Homo sapiens
tagccaggcaaatttttttcagtggatatttattttaatagccatttggtttcattaccttttaatgagttctttgatagcaagttccttaattaacaaggcagtctttcaggtttcctcttctctaattgttaacatattttggtgctttcacacagatgcactgtgatgaagtttcctcttttacagctcctttttgggccattcagaagcagtgaagaagagagtggggagaatacatggcatttttcaaaaagatataaattatttaagagtatcctctcaaactgagtgaaatatttacatttcatgttctcttctctacaacgtgattaactcagtggatttctaggtg

SEQ ID NO: 260783 - DNA, 387 bp, Homo sapiens
tgctgcggctaagatgctttcatgtcccacgttgggctggttttcgtggcaaacgttagccctgaaatgtaagtcctgcaccgcacgttcagcaaggactccctcaggtccgggccaagccttgacatacatgctgggcacccacttctccaggcagagttctcatccctctggctcaccagctcagaacggcacgctcagtaaatgccagtgcttaggacgtatccatgtgaggtcttggtacaatcctggaaacttcctttgggaaatgcatgaatgtgggaccctcctcatcgccctgagagtccagagtgttgcctgcccagcgtcactccacaacccatctgtcccctggatggcaggagccaggccagacgccccatcata

SEQ ID NO: 260784 - DNA, 350 bp, Homo sapiens
tgaggggtaaacacacagatggaggggaaggagtggagaggatgccgggcccaggaagctgcctccatatcagaaagcacgatgagttaattctgccgtattgaatcggtttttaatctttcctttttcttttttgtgtttgtatgttatcttgggaggttttgttaatttgtgatggctatgttttgaagaagcaaataatttgatactgcagttttaaaagggtcgtattttaaagttactattccaaaaagtattgtacgaatgttacttttatgacacagaaaaaatgcagatgtatccactttgtgtgtttatacatgcataaagagaaattctatttaatccca

SEQ ID NO: 260785 - DNA, 571 bp, Homo sapiens
tcatcgcaggtgcctggtaaatggtggatctccccacccctcctcaacacacagaaaacagggcgggcagcgggcaccactgcactgtcaatgaataactcacctctgtagtgaaccctgggagctgagcaggagggtgaaacgggaaggccggtttcccactaactggcaggcaaggcaaatgtgggctgtcctatggcccctctgcaggtgcggaatggcggggtttgtgagccccttttgttgtcgaggacagctccacgggggtccgggaggtgcttgctctacagacagaagttgggcagtcttgcgccccctgaaaaggttcagagtagggtggccccagaagagactccagggcatgtgtgggggagcactgggcacaggcagagttaggctttggctgtgagtctgagcagggcctcagatattgggaatgggcaggagatcctggctgtgtaagttggggatgtgaggtctggttctagatcagccttttcagtctgccctggcctggtcattaataaaagtggggccaatgtgttccctttgagagaccaagtggcttgga

SEQ ID NO: 260786 - DNA, 437 bp, Homo sapiens
agccttagaaatagctccctttaggtcaccaaattaacaggagtttctaaaggatagcagcttttttgcaactgctgcatctgttagattcatgttctctttgctcccttctccccaagcttctatttcatgatctttttgttgttttgctctacttttcctctttttaaaacctctgcattggccacccaggatttaagaggagcttttctggaaagctgtctgaaacaggaacaaattacacagaaacactgagagctgtgaacttgtgtgtatacctgacatagtgggagaggggggcttccttctaagtaatagagaagagtgaatattctaatcattgagtagtggtcaggcctgtaatcactgctttttcttttgctgagctcggtatcaacggacaagctcaaaaattgtagctatttaaaattactctc

SEQ ID NO: 260787 - DNA, 421 bp, Homo sapiens
aaatatcgttttttaactgggcacactgttgtccctaacaacatggacttgtggttgacaacagaggaagcagaagagaatgcatactggaagtctctacaacagagtgctgaagacaaccagcttgatattgtatagtactctctcctgtgagtgggcctggggacaaatcatttaacttctctgtaaccagggtctacttgatgaagtaacctcattgcccacaccagaagcatcaggaagggtaccaaggagatggtagcttcaaggactttggaccacttggaggagggtattcaaagggacagaagtcacttgcttgattcttgtattaaaatcaagtgggatttcttttcattcatgcatttcaccagtacttatcacgtatccaataaagcaacaaggacaatccaaacactgt

SEQ ID NO: 260788 - DNA, 223 bp, Homo sapiens
caggagggaagcagcgcttcaggggaaggatctaatggctgtgacctgcgtgggctgcagtatgttgttctgcttgaagcagatgaaggaaatccagcctcacacagatatgttgctcaagggcagaccctgcacactccctgaaagggccctagggaaccaaagatcacactttgagaactgctgctcttgaggcaagactggattaaatttaaaggcaaca

SEQ ID NO: 260789 - DNA, 251 bp, Homo sapiens
tagaattctcagtggaatactactttataactcagtgcttcccagggccacacactttccctgtgcagtatgttccaagaatgggatgttccacatttggaaaagaaatactcatataaagtcctcacagacatttctcttttgatttccttctaccatgatttatgaagcggtcacagcatttgtctcaacctgagccgcagagttgaacagattttcagcattttcagaggagtatgcctgtgcctacc

SEQ ID NO: 260790 - DNA, 711 bp, Homo sapiens
cagaatgtatttttccagtagcaccacccaaaacttgcattaactgatgagctctgatttttatcatttgatttagttaactccacaagtttgaacctacctctatggaacaaaggccataatctatcatactttttaaaaaatggacaatcttctactgtagattattagcttttctggtatttcagctaagcttcatgcacatttactctaacacattataggtctcggtgtatcaatctgatattttacaagaggagcagaatctgctaagaatacaggcatatgtcattttattgcacttcactttattgtacctgcagatattatggtttgttggtttttttcttttttttttttaagacagagtcccactctgtcacctaggctggagtgcagtggcacaatattagctcactgcaacctcctcctcccaggttcaagtgattctcccacctcagcatttccagtagctgggattacaggcacaccaccacacccagctaatttttgtatttttagtagagacagggtttctctatgttggccaggctggtatcaaactcctgacctcaagtgatccaccccccttggccttccaaagtgctgagactacaggcatgagtcactgcaccccgctgggttttttttttttttttttttaaacgaattgaaggtttgtagcaaccttgtgttgagcaagtctatcgg

SEQ ID NO: 260791 - DNA, 124 bp, Homo sapiens
  misc_feature (1)..(2): n is a, c, g, or t
nngaccatcttcagtgtaactcagggaaatgacctcactctgttgctcctcgtccttggaaacggagctggttgtatctaccgtgcagggatgtagagggcttaaattaagatgctccaagctg

SEQ ID NO: 260792 - DNA, 496 bp, Homo sapiens
tccttcctaattctaggcttattcaccaacaaccctgtggtttagaccctggattctgagaagagaggtccctgagagcaaggatgtgtatcctggacactagaaaaatgtatccccctccataaattactagcttgatttttctaggatttgtcactctggcagaaaatatccattctccccgtcttctttagttaggcagcctgactttaattatggcagccatgtgctcagcgaaaagactacatttcccagtagcccttgcggcagggactggccaatggaatgtgagcagagccgctgggagggacttccgggaagcgggcccaaggcctcctgcctcttccccatcctcgctcttgcgctctgggaagtggactcgaaggcaggagcccctccagctatgctgggatcgtgcggatggggacaggctgggcccaggctgccttcatccattcttttatgagagaataaacctttagttgtttaagccact

SEQ ID NO: 260793 - DNA, 161 bp, Homo sapiens
actaaggatatatatcaaaacccttatggcagactgttatttgtaattgtattttatttgtcgtgcttatatgtgttgcccaagtttctatggtgaacggtatgcatcactttcagcatgagaaaataactcctaataaacgtgattcttaaaggactctc

SEQ ID NO: 260794 - DNA, 546 bp, Homo sapiens
tagtggggccctccattgcaacaaaggtgtgggtgagcctgggtgagtgtggcaagaaatgcctcggaggctgtacttggccttaaagggctgtgtgaccttgggtaaactgccttctctgaatctctggtcctttccatttcccattctccaggctgagaactgcactctgatacacggttattcccaataataataatgtgtgtatcacacataatgcactgcacctcttcaccatgctggcacctactcctctgctccccctgccagcttcctcagccccttcttctaccctgatggttctctccttgcctcctcaggccagcacttcccatgatctgagatgtctctttccttttcacctttttctccagcagtgagttcctcctcctaactcaggcttccaggaaggatatcctctgcttctcagacctgaacctgcctcgaatactcatgaggacccaggagctactcctcacctcccacttctcttctatcctgtcagataaccaaggcacggccaactgatcctccaccatccgagga

SEQ ID NO: 260795 - DNA, 439 bp, Homo sapiens
tttgctttcaaactttctgtgccatcatggtagatagtatagcatagtagacatgaactccagaaagactgactctgtcacttctagctgtgtaactggggatagttactcaacatctgctatggtctgaattttcatgtctccccaaattcatatgttaaaacctaattgccaatgagaaaatattaagaagtggggtctttagaaggtgattaggtcatgagggtggagcctttatgaataggattagtgctcttgtaaaaaaagcccaggggagcttgtttgtccttcctgctatgcaaagatgcagcaagaagatgccttctatgaaccagaagacaatcctcactggatactgaagtgaatctactggcaccttgatcttggacttcccaacctccagagttgtgagaaataaatttctgttgtttataagaaa

SEQ ID NO: 260796 - DNA, 630 bp, Homo sapiens
atgggaaaggggagagcacaaatgtgtagtttagcaatatgctttaaaaaaaaacatattaaataaaagatctggaggtaaatctaatgctataactctgaaggagggatgaatgtaaatggtagtttgaaatatctgcaataactctaacttgatttgacaatacctgtgatttctatttgggacagagtcacaggtcctggtaatattactgtagtctgtttcctacattcataattgaatatgatgttaaatttcagtgtgaagttagtgaaaacaaaatgcaatcatttccttatccgggttcacagatcagcaagaggacatagactccaggttaagaacacctgtcctatgggaaggtgagtggtagggactgagttaatgaccctaaggggaggctgtgatggacagagggaaggagggatggcaggctcagcctaggacagcaggaggaaaggtgagcatggtgtttctgaaggcatataagaagacattagaaactgtggttgacttcattcacctcaattctaccacctcaggactgacaaggagccacctttaagcctggcggtttagatgagaattttttccttcttggcttaggaggtgaaattgttctttagcacc

SEQ ID NO: 260797 - DNA, 491 bp, Homo sapiens
gatcaatttcaggaaaatcaatgtgacgttaagcaagacatttattgtgcccacagcttcaccattctggtctctatgattccctgcgaagattgctgttatcccccagagacacagctgagctgtctctctaaagggcctgtgttctactcctgaatctggtttcccctaagcttttatctcaccctggtgacagctcagaaacacacaaactctgtgttaagaaaactaagaagtcattcatctgcacatttcccgaaatcccccagaagcccgtattagactgaatggtgtccttattgcaaactctccactttagccaaggtgcaaagtcctcccagtcccccaggagcttcccttctctgagcggtacttaagttttctgtaaaaccactcagttcaacaaatgagcttctcaatcttagtttctgcttgttgactttaaagttaatctataataaacacactgcagtcctcttccctgactcatt

SEQ ID NO: 260798 - DNA, 437 bp, Homo sapiens
aagactgctggctttttaatatcttccaggtgctacaaaagccacatatagtcttgtatgttgacatgggccctgcaaggccagggcagaagagtatgactccaccatgtaaaggatgccaattggtggagccatggtagctggatttgggaggctgactagttcacaacctctgataaactgtcatccaagcctgaaccacggtcacataggagagccaggagtaaatgcattttaggtggcataactccttgtgttgcagcaaagaaagcaattatgaaaatggtcctgcattcattggaatgaaacctttgattctgaaggttactcatggactactgtgttaaatcttacttgataccatttaagtctgtataaaagtatgagtacatggtcagttttatcatgtaaaccaaatataatgcatttataaaatt

SEQ ID NO: 260799 - DNA, 533 bp, Homo sapiens
ttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgttaaacagt

SEQ ID NO: 260800 - DNA, 431 bp, Homo sapiens
gttgaagacactaataagttggttctcttgacatcactgaaaattgtcattagctttacatacctagaaagaagttcgccccagaagatgtcattcctacaattccctcaaacaaatagtaccgtcaggttttgccagcctgcgttcgtttgtggtttgccatcccttttccccattcacagactctgattgtatagaatttcattgaccagttagaaaaaagcataaactaaatactaaagaaaacatttgcctttaagaagttcaagaaattacttatttcatgtttgacaaagtcctaaaacagaaaaatgaataatatttctgttaattttccagatattttctttagtctctgaagcaaattcaagcattctattaatggatagtgttcatttttcttattatattctccttcaaagagctttaga

SEQ ID NO: 260801 - DNA, 213 bp, Homo sapiens
aatcctgtactaaaacttactcttctgtatctggctttttcacccagtaacaaaactaagattcatgcatgtttttgcacatatcagtagttcattctctttcattgctgtgtagaatttcattgtataagtatgtcacagtttatttactaattctactcttaagttgtttgcaacttttggatgctataaatacatttgaagattaatttt

SEQ ID NO: 260802 - DNA, 788 bp, Homo sapiens
gtggacaacagaagaggctaaagcagcatgaggaagacagactggggaagaccttacatgtcttaaggagtttgaacttttatcctgagaacaatggaaactcactgaaaagttttgcataggagtgacatgctcacattttattaaaagagtggaaagtatgtaaaaagtaaggctggatgcaaggtgaccagtttaaaggttgttaacagtcgtctgagaagcaatggtagcccagagaggggaatggaatggaagatgtggatgtactcaagtgatgctaaggaggtagatatggtaccactttctagatgtgtggataagagggaagttgagtcaaggaagatacccaggtgcgttaggggtacatagatggctgcccttactaagatacagaattctaaaggaggagtaggttactgggtaggtactgctacattcaaggtggctattaaaaaaacaaacaaacaaaaaacaaagaaaaaacccacacaaaaaaaacagcaaaaacaaaaaataagtgaaaatgtcttaaacatgtttcagttatagctaaaaaaaaaaaaaaaaattctccagtacacagataacacttgaattcaagggtatgcctaagaatgctgcatgagaggtatatgagaagaccagaggtccaggactaagcctaaaactgtacacagtaggtatgagcccatgtcaacttcctttagcatcacttgagtacatccactatcttccattccacttcccctgctctgggctaccattgcttctcagatgacctgtta

SEQ ID NO: 260803 - DNA, 900 bp, Homo sapiens
tgggaagctgcgggggcggcggcaggagtcctcaaatgcctttgccgcttttcataaatctaaaattacatccaaacagaggtttacttttttaaaaaataaaagaggccaggcatggtggctgacgcctgtaatcccagcgctttgggaggccaaagcaggagaatcactgcttgaggccaggagttcagactggcctgggcaacatagggagaaaccatctctccagaaaaaaaaaaagaggaaggaatgacccaaagaccatgcagcctgtgatgctgtggaggctccaagcaggcgaacacaggacaggccagcatcttgcagggacgcggcggggggtaccgcgtgtgcgtgcatatcacgccccgtgcatgtgtgtgcataagctccccggacacatccgggggtgtgggtcctgcgggctgcctgtgcaccagggaggggagtcagcaggagagagactgtacgtcgtgcctgcctttaagttccctgaattttaaaccctgtggtttcatcacctgttaagacaaaaatctcaaaatgactgttttctgcctcctgggtctcaaaggcaggtgcaatgcccagaggctggtcctgcacagagggacccagggcgtgctggccttcccagtgtcccactggtggctgatctaagcagtgctttccctcgtttttttattttgagacagaatcttgctctgtcccccaggctggagagcaacggcacgatctcggctcactgcagcctcccgcttcagcctcccagatagctgggattacaggcatgcgccctcatgcctggctaatttttgtatttttagtagagacggggtttcaccttgttggtcaggctggtctccagttcctggcctcaagtgatccgcccgcctcggc

SEQ ID NO: 260804 - DNA, 311 bp, Homo sapiens
tgttgtttttttattgtttgtgatttattatgacttctctttttttctggattcattgttaaattcaagctcctgctgaggaaaacgttaaaatgtatcgctttaaggaggtgcaacaggcaggagtctatggaactcttaatcttagctgctgcctccactttgatacaatgctagataaatgcgagcatctttccctaaccttcctcctgaatgcctcatcccttgatcacaaaaacatcccttaataatagggggaaaaccccaagtatgtaaccctatccatagccaaaataaagtctgcatgccac

SEQ ID NO: 260805 - DNA, 432 bp, Homo sapiens
gcccaggccagagtgcagtggtacaatcacagctcattgcagcctcaacctcctgggctcaagtgatcctctcacctcaacttctcaagtagctggcaatacaggcacataccactctggctaatttttttgtagacacagggttttgccatgttgcccagattggtctcaaactcctgggctcaagagatctgcctgcctcttcctcccaaagtgctaggattacaggcatgagccactgtgcctggccaggagctcatgttctactgtcaattcttggaaatgtcccatatacctgaatagaatgtatactcttcacttgttgggtgcagttctacatatgactgttaaatcaagttgcttttattactcaaatcatgcatttccttactgatttttgcttattatctcaatttctaaggagaggtatat

SEQ ID NO: 260806 - DNA, 485 bp, Homo sapiens
caggggcaactcgaagtaccattactatgggattcgtctgaagccggactcaccactgaaccggcctcagacgggccacgcaaccataggcaggcctgcagagttctttgaacttcagttggccattggtataaagaggaggacaagccatgcgtcatgggctgttgtgaaaagggaatgagtcaagcatctctccactggtggatgctgcagcctcctttgctcttattattgttatcgttgttactatcaagcttttagaggcgtggatcaatccatccatgagacacctggactgaatcaagcaggggaagtttccctgcagcctctgccgagttctcgctgccatgccccgatgcaaaataacgacttatctgcttttccagagtctctacatttaaaactcgattacccgtgtttacttttcatttattttccttcttaaattaacacaaagtaaaatcaactttttggtgtacagcctt

SEQ ID NO: 260807 - DNA, 509 bp, Homo sapiens
cagggatggtgagtaagaggcagccggaggcccggaggggctgtcgtctgctctgggcccaggcggccccacgatggagtcgggccagcctcagacgggccacgcaaccataggcaggcctgcagagttctttgaacttcagttggccattggtataaagaggaggacaagccatgcgtcatgggctgttgtgaaaagggaatgagtcaagcatctctccactggtggatgctgcagcctcctttgctcttattattgttatcgttgttactatcaagcttttagaggcgtggatcaatccatccatgagacacctggactgaatcaagcaggggaagtttccctgcagcctctgccgagttctcgctgccatgccccgatgcaaaataacgacttatctgcttttccagagtctctacatttaaaactcgattacccgtgtttacttttcatttattttccttcttaaattaacacaaagtaaaatcaactttttggtgtacagcctt

SEQ ID NO: 260808 - DNA, 840 bp, Homo sapiens
atttcaccggcaacaccaagagggtttttagtggcttgggtctccccagtgggggataagtcttttgtcatcaaggaggcaaattgtctccccaagacagctcaaaatatccacacctcggcaacagtctaagatgagagcctgtgacaggtggcagcgcccccaggtggggtactggcatcagagcctggtgcgcccctaggggagcctcccactggagtgcccggccaggtctccaagccccaaatgagtccttgtgaaccacaactgatccccccaggtgggtgcttgtggactgcctcggacccagccacgctgctccccgcaatgctgatggggctgtgcattgaggacccctgcttcctggttctcagtcccaccccaaaacctggcacccagaacagttggaagtgtggaaaggaggtttatcggccttcccttggagagggcctggcttcaacattgggccagtaggcatcttagcttggcaggtgtcgggggaatgggccagatggacctgctagatttggaagggcaccgagggagttttctgggtgtagagagaatggaggggaccaaaaagagtccttcctggggtgtgggaggcttcccagcttggtcctcagtgggttgttgaggccagagtatcgccctgggatgtggtggggagctgggccaggagagggactgactgtgaccctctgctggccggtcttgtgtgcgccccatgggacccccagtgttcttgcctgtgacctcttattgcgacatgcaggtggtgtttttttttttttttaaactctgagctattttatcaataaaggatattttgtaataaga

SEQ ID NO: 260809 - DNA, 175 bp, Homo sapiens
tttggagggtataggggaagatgaagagtgttttcaatgtgaaaacttaagccagtgctctctatattgttcaaatagtgagagcaggtttagcagagacagtaatgttaatgtctttgggtccgtaataacagcccagtaggataataggtcaaagaaccgacattctctgtga

SEQ ID NO: 260810 - DNA, 382 bp, Homo sapiens
cccttcattagcaagtccctcaaaactctttttatagggggaaaaaaatcaaatagcatgtcactttctacattttcagtatttcaattttaagagtaatagaccaggcacggtggttcatgcctgtaatcccagcactttgggaggctgaggtgggtggagcacgaagtcaggagattgagaccatcctggctaacacggtgaaaccccgtctctactaaaaatacaaagaaattagccgggcgtggtggcggacgcctgtagtctcagctactcaggaggctaaggcaggagaatggcgtgaacccgggaggcggagtttgcagtgagccgagatcgagccactgcactccagcctgggtgacagagcgagactccatct

SEQ ID NO: 260811 - DNA, 276 bp, Homo sapiens
gcaccctggctccagctgtcatcacatgatatgcctgatcccctttccccttctgccatgaataaaagctcccggaggccgccccagaaactgagcagatgctggcgccatgctcatccagcctgcagaactgggagccaatgccaattaaacctttttttttttttttttttttaaacggagtcttgctctgtcacccaggctggagtgcagtgagccaagattgcaccactgcactccagcctgggcaacagaacgagactccatctcaaaaaa

SEQ ID NO: 260812 - DNA, 476 bp, Homo sapiens
accttggaggcctgagtgttcttaggtaaaagactgctttggaggctgcaaatggaactagaatcccaccagatcacagccatctgacttggttgcatttttatggaaaccagcgtgttgaggatgtgagactgatataaaagcactaggatattcacagggtaaaagtcaggaggatcataacagcacagtactagagaaccagtacgtagtggtgtgatgaatgaaagccactgacataactttcgcatcttgtcttcctgtattctttctttctgtgacagttgttgagatcatgacctcttctggaatggtgttctcagaagtccttggacaatcagggtgtactaggagaaaacatgctgtgagatgggatgaaagtcttcaggatggacactatactttctgttattggaggattcggtagtttgaataagcgtttgaatgaataaaatatttgagttgaggactaaatt

SEQ ID NO: 260813 - DNA, 379 bp, Homo sapiens
gttgtgttgcagatgcctacagtattcagcacagtaacatgctgtataggtttgtagcctaggatcaataggctgtaccacataacctagggcggagtctcactctgttcaccaagctggagtgcagtggtgcagtctcagctcactgcaatttctgcctcaccctcccaagtaattgggattacagttgttgagatcatgacctcttctggaatggtgttctcagaagtccttggacaatcagggtgtactaggagaaaacatgctgtgagatgggatgaaagtcttcaggatggacactatactttctgttattggaggattcggtagtttgaataagcgtttgaatgaataaaatatttgagttgaggactaaatt

SEQ ID NO: 260814 - DNA, 429 bp, Homo sapiens
gttgtgttgcagatgcctacagtattcagcacagtaacatgctgtataggtttgtagcctaggatcaataggctgtaccacataacctagggtgagtagtaggttatgctatctctatttacacatagaatacactatatgatgttacacagtgaagaaattgcctaatgcatttctcagaatgtaatttttgtcattaagtgatgcaacattgtatttaaaacactataaataaattaagatggaaacttaacatgtttatgtaacccattggaaagcaagaaaaagacacagaggaataagaaacagaaacaaacagaaacaaataacaaagtggtagacatcaaccacaacatacaaattgttaaacataaaaggcctatagaaaccaactaaaaaacatagattggcagagtagttaaaaaaaca

SEQ ID NO: 260815 - DNA, 427 bp, Homo sapiens
gccttccatggcctactcttaaaaataggcttctctgccaagattttaagatccttcatgatctggacccacacagaccattgcaacctcacttcctaatactagtcagcatgcacatcttttatagccaaacaatcatactagcagccctatacttaaaggagtgatatgcagcactcccatgttcattgcacattactcacaatagccaagatatgaaatcaacctaagtgtccatcaacagatgaatggataagaaaatgtgctatatacacaagatacgaaatcaatctaagtgtctatcaatggataaagggataagaaaatgtggtatatatacacaatattattcagcctttaaaaagaaagatcatttgtgacatggatgaacctagaggacgtatgttagacaaaataagccaggaat

SEQ ID NO: 260816 - DNA, 405 bp, Homo sapiens
gatcatatagcatcttgcagcaccataatttatttaaccagaatcaaatgaacttttgtttccaatttttgctatgccaagtaatacagcatttcctttcctaaattctttgtctttaaaagatactaaaatctcttcatttaaatataaagcaataaaaaaattcttatgctataggtttttgtgcaatgtcatctctcctgttatcccacttaacagaaacaagagtaacaaaaaactaaaagtaaaaacgttgaagccaggcagttccagctactgaggaggctgaagtagaaagatggcttgagcccaggagttccaggctgtggtgcactagaatcacagctgtggatagccactgcactccaggactgggcaacataacaagactccatctcttttaaa

SEQ ID NO: 260817 - DNA, 245 bp, Homo sapiens
cctgtgtcccagaaaagagaaaactgcaacccccaaagcagaacctattcttctgactgcatcacatgggtgaggtaagttcccatgcctccaaggggctcatggattctccctgggcaggatggctaccggctttcgctgtgggggcatttcatgaattttctttttttttttttttttggagatggagtcttgctctgtggcccaggctggagtacagtggagcgagactcagtctcaaaaaa

SEQ ID NO: 260818 - DNA, 175 bp, Homo sapiens
ggttttccgacgcacgatgttgtccttatgaaaaattggtgatgaaggaagcaaacgtgtgggaaaatgatcctgcccttaaaactgaaaaacaataaaacagcaaagagcccagaagagcccgtgaacctcctcatggggcagtgaggagagacctcagtaatggcttgggaaa

SEQ ID NO: 260819 - DNA, 507 bp, Homo sapiens
tgccctggcagaacctccacacccactcggctagaggagatgggagcagtcctaggaaagaacgcttcagacatccactgttcttacccaacgttcagcatgttatcaagcttaaacacttctcagattgttgtatgagttttattgatttccagagcaccaaaatagttgttcttgtcaattttgttcagacttatagttgctttctggggagaggatttgctgacttttcacatggctgtagctggaaatacgcttccacccccagtgtttctgattcattagacccggggtgcaactggagaatttgcatagcccaaaaaagaagtgtgttacagttcctcccccactctctctcttgctcctgctttcaccatgtgaaatgcctgctcccacattgccttctgccatgaataaaagctccctgaggccccccccatgaagctgagtgatgttggtgccatgcttgtacagcctgcagaaccgggagccaattaaacttctttt

SEQ ID NO: 260820 - DNA, 389 bp, Homo sapiens
ggtcatagcccttagtccttgggacctcactgtgactgcacacctaccctgggtgacagcctctctgggctgttgtctccttgtcccggtcacagtctcctttgagaatttgacaaaagccatgagcctttctgaagaaaaaaggcagcgatacaattttgcttataacctcagggagtttctggggtccctgaagtacaaccgtggaccccaagctaagaatctcaaaggcctttcccagcgttgtgattctaatctcttcagccttcctggctgtgtgtggtgtgtctgctgacacctacacactagatacctatctatgggttatgaccttttcttctggcatgtactccaaaaatacaataaccatggccttagtagtctggcta

SEQ ID NO: 260821 - DNA, 587 bp, Homo sapiens
cagtgtttctcaccgctggctgctatgtattagcatcacttggaaacatttttcaaactaccaatttaggccccacctcacagatttcgacttaatttggccagggcggggatcaagtatagtggtactaaaaagcacctttctttttagatgactctaacgtggtcacctgaaccttctgaggttgactctaacgtagggccagagatgcaaaccacctatatggatgatgaaaccttttctttactccttagggaactaagattctgtgaatacaccgttcccctgggtctcaaactagctctagaggaggccctcatgataccacctcagcagaggtgagagagtaaggaaccattggtagagccagtactgtggagaaattaaaatttaactggtgagggacagcttcagggttaagagagttggacctcctaccttgaaacctggctccccacctgccactgttccatagtgcttggaaaatatgaatattttatgtgcctcagttgccccttctgtaaaattgggattatactaatgggttgttatgcatatggaaattaatatgtgaaacctgtacatga

SEQ ID NO: 260822 - DNA, 1019 bp, Homo sapiens
aatcctacatattgtatgggtatcccaaagagaaaatgaggttgcttagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260823 - DNA, 182 bp, Homo sapiens
  misc_feature (12)..(12): n is a, c, g, or t
  misc_feature (182)..(182): n is a, c, g, or t
tgtgtgtgcatnccatgtgtactgtgtgtgtgtgtgttgtgtgtttgaatgaaaaatgcttatgtattgacagaacacttctagaatgatacccaaactcctggagtgggagtggggaatgccttctacgtacacagtacactggatgcacacacactacctggtagcatgaagattgggan

SEQ ID NO: 260824 - DNA, 4505 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260825 - DNA, 2532 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatca

SEQ ID NO: 260826 - DNA, 4328 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260827 - DNA, 4643 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaaatccctatgaagttggtcactggcatcacattcgctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260828 - DNA, 4397 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagccaaggattacctttagaggaatggagaataagacagaagagggagggacctgaactagccaataagaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260829 - DNA, 4502 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagccaaggattacctttagaggaatggagaataagacagaagagggagggacctgaactagccaataagaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260830 - DNA, 1535 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttct

SEQ ID NO: 260831 - DNA, 4394 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaaatccctatgaagttggtcactggcatcacattcgctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260832 - DNA, 1358 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttct

SEQ ID NO: 260833 - DNA, 3361 bp, Homo sapiens
cggacgcgtgggtcgacccacgcgtccgccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260834 - DNA, 407 bp, Homo sapiens
gggagggacctgaactagccaataagaggtacaataagacttttgtttcagtaaaataatgcttgtttattctacaggttatcctctacatcagggacaggcactggtgacagtaatagccttaaggctataggcaccaaccaaatagtgaatatagttggctgaaagttgggacaagactttgcgctagaactagaactagtattacaagagattcattcagggagcatatccgatgctacatattcataaatatggttgttaatgcatacagtttggctagttttgcctttgaaattaagtgtactgtatgagtgtattgcaaagtgttaagtcactgtatgctttagctctttcaatggatgaggcaaatgtgcaaatagattaaactgacttttacagaataa

SEQ ID NO: 260835 - DNA, 1430 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattt

SEQ ID NO: 260836 - DNA, 4468 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260837 - DNA, 4610 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260838 - DNA, 4433 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcaggtgccctggaagaagggacgtcagagggtcagttgtgcgggcgctcggcccggcctcagacgggaggtacctgggagtcacagtggtccaagacctcgcagcctgaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260839 - DNA, 4433 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260840 - DNA, 1597 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctcggcctgctgaatcgcgaagtgcatgttatcagccgttcctggatgggcagcgaccgccagt

SEQ ID NO: 260841 - DNA, 3763 bp, Homo sapiens
gcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaaggtggattcatcattcctttccctttatgacagccacgtagcaaaggagattcttcttcgagtacttacgctatttcagaatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattttgtcattaacacagctataacttgccgtggttctcagatttattttggactattttgatgccaagtgaatataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaatgatggagctccgaatgtgcttaagtggaaagatatctatgaaatatggtggttttttaaaacacaaaaattatagaatatgggatcccgtgtgtgtgtgtgtgtgtgtgtgtgtgtgtgttgtgtgtgtgtgtgtgtgtgtgtgtgtgtttgaatgaaaaatgcttatgtattgacagaacacttctagaatgatacccaaactcctggagtgggagtggggaatgccttctacgtacacactgttctactgtttgaattttttaatatgagcccaaattgtataatctttttttaataaaggggagaaaaatcacttacaaggttatacatattttttcccttgacagtactttattaattttcatccatattttacttgactaaaaatacaatgtatgaaaatttatctttaatagcattttccataagctactataacaatttattgatacatctgggattcagccaggtcttatagtatttaaatttataacccctgccatgcttagcattaagtaaatcagtatgcaagcagtatttaaggcaaagctttaagaatactttaaatttcatttgtaaatacatagatgcaagactgtttccataggaagtcacaaatcctcaaacagaaatatgtgtgttctcaatgttaccctgatacagaaatcaaacttggaagaaatatttttacattagaaaaaggactcagtataaggtgaaaacaaaattcccagtgggctagacatgaacaaaagtattcattccccaaaaggcacatttctttataacagttttttcaaatctacctccctatttaatgaaagcatattcattaaatatgaaactatgcatacattaaaaaccaggatttgtttttaatgtgctttagcagcagtagattctaaaactgtgtctcttgtcctctcattagtttgaataatcacactccctagagatcagagcattgagtctgaaatgtcaaaatgctagagaaaagagggagtaatttttaactacccagaaagaagatgcacaaatacatcttttcctacgtaggtcacggcatatgttggcttttataatttgggatttctcctaattgatgacccaccctattgggcagtgaggcatagcaaagtgttcctcagttatcacaggaaacttcaataaaatcttacatattgctatgggtattcacaaagaggaaaatgaagttgacttagaggataagactgattaaaagacactacaatgcatattagactgaattgaagaagagaatggatttgtcttatttttcaaaatttgttttcactttgcacataaacccttcaaaatgtagataacaaatgaaaaataaagtggaacccactcaataaggtgagattctgtaagcagagatgaagcttgatgttcttaatgaatagtgtcagtgtagaaagaacatgagtggtaataaaaaattacagcttacaaaagggcctagaaaaatgaggcaggccagacgagtggaaatagaacacaacagtttaaagtgctttgagaccctcagttaaacagtacacgtgaatacaaaataatgttaaggccattcatggagaagaaatacttaagcaagacatacctggcttgcttcatagagaagaggtaagagatggattttcaattcggcgtgcagcagcagggaatatggctacaacaacgctggctagtattagggcaacacacctcaaagctaactcaccataaacctaacatcttgattcacatctgcttggagtgaaaaagtttatgatcagtcttttcaggaaggtttattttatgggggatttttttgtgctttagtaccccaaaatcacatatgttcgcatacatcatatacacacacattgcatacacatttccccttgactgattcgcatctttgtagataaacactaaattttgataaagattatttacacttatttaggctattactccaatttaaaaatcagtgaaagttttcaatgtttagtctcctaatatataatgcttaaatttgcaacaggaacaatacattatcaaaagcattaacctgtatttagctttcaaatatacctgtctatattaggcagtgatatcttaagaaatcattttctcccttatattttctaaagtgctttaaaaactcatttaatctacacatttttcagaggtaggtcggaattatcctcttgttgcaaatgaggaaacaggcacagtgagca

SEQ ID NO: 260842 - DNA, 1301 bp, Homo sapiens
gcaccgccccgcgctccgctgccagggcgggagggaggaatggttgcttcacgccccgggggaagagacgggaagctcggctctgggttgcgggccccggcgtctccgcgtggggcgcaccgtccgacccgcccctcccggtgtgcagcgccccgcaccgccccgcctcgcctgggagaagccgccgggacgcgccgggctggagtgggcggttataggctttgagctaggccgtttccgggaggcggagctcagaccccatttcctttctccacatccaggtcaggtggcgtttgctgtggcggctaggcccgcgtgcgctggagacctccgcgctggcccccgcgagcctcctgccctggcccggcgctgcggctctgccgcggcggcagcatgggtggcccccggggcgcgggctgggtggcggcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaacggaggatcctgtaattattgaaagagctttgattactttgggtaacaatgcagccttttcagttaaccaagctattattcgtgaattgggtggtattccaattgttgcaaacaaaatcaaccattccaaccagagtattaaagagaaagctttaaatgcactaaataacctgagtgtgaatgttgaaaatcaaatcaagataaagatatacatcagtcaagtatgtgaggatgtcttctctggtcctctgaactctgctgtgcagctggctggactgacattgttgacaaacatgactgttaccaatgaccaccagcacatgcttcacagttacattacagacctgttccaggtgttacttactggaaatggaaacacgaaggtgcaagttttgaaactgcttttgaatttgtctgaaaatccagccatgacagaaggacttctccgtgcccaagtggattcatcattcctttccctttatgacagccacgtagcaaaggagattcttcttcgagtacttacgctatttcatgatgcagaggtgaaggaaaaggttgtaacaataatacccaaaatctgattggtcatatttttccaaagagtaatgcagtctggatataaatgtattttctgtcttccttataaggggattctcccagctgctaaatttaaacagtaaatatcacattt

SEQ ID NO: 260843 - DNA, 388 bp, Homo sapiens
cagagctttgtcaggaatctactgagctgctgtttccttcccagcaggtcctaactgctttagatgagtcccagctaagacatccaaattactaactgcttatgatggccttctcaagaaatgggctatttgaaagagacatcaaagcatttatgggactctgtctgacatctggaaatcggcttcgtggtataaagaaaagatatccatctgaagtcaaactacatcagctgaaaaatcaggagtttggaagtttgactctaaatctactgttctctccaagaagttatcaatgtcttcaaaacgttgattactttaagacaggcttttctgcaaactactatcaatgtttataatattaaatgtttacaatattatatgttcataa

SEQ ID NO: 260844 - DNA, 848 bp, Homo sapiens
gtggttacttagatcccagcactagtggtgctgggccagacaccggaaaggcagctctgatattgaggagggtgtgacctgagccccttgagacttagaatcacctctcccctacaggctcagctactcagataaagctgaccctggcatcagggggacggaaaggactctagcctcagctgtgagtctggattctccccagggctctgcttccctgctttgcagcttctgacaagttatctgcccacccacctctgggcctcagcttttctatctggaaaaaggaggtggggattggagtcagctgcctcctggggcccttccaaccctgctctgggtccccgtaagccttcctcagccaggataggtgtgatagaactacatgctcagaggaagccaggcctgtgatgtatgggacacggaggagctgggtgaactcttaaggagtcttctttaattactaaattctctaagttaagcaggaacaatgaggacacaaagcacttaatcagaaatacacaagccttgaaggctgacaaacagaatgggagtgatggctcccaaagaggctagctcaagtctctgcaggacaggctgaacctccctcagggctactcttaccttccatcctactaggattcccaaggtagggaatagctgggcggcttctatccaagttgcttctgcctaattcactcttgcctggtgaggctcagaatttgagggtagttggccgggcatggtggctcacgcctataatcccagcactttgggaggccgaggcgggtggatcactaggtcaggagattgagaccatcctggctaacatggtgaaaccccatcttcac

SEQ ID NO: 260845 - DNA, 451 bp, Homo sapiens
ctacctgacttcaaactatactacaaggctacagtaaccaaaacaggatggcactggtaccaaaacagagatatagaccaatggaacagaacagagccctcaaaaattcggcacgaggtcttgctatgttgaccaggctggtctcaaacgtctgaactcaagcaattctcccacctcagcctcccaaagtgttgggattacaggtgtgagccattacacccagcccactattccttcttatttgtctctgggccacactgaccctctgtctctttcacagcctaggtggaacttttttttctttttaaacgaagtccttttgatggtgacttacatcagagtctgttttttctacttgctgcttgttaggaggcaccaggttttgaatgtcctacatccttttttttctgggggtttcagggcagccagtcttcgttttctggatctaact

SEQ ID NO: 260846 - DNA, 1650 bp, Homo sapiens
  misc_feature (1035)..(1035): n is a, c, g, or t
  misc_feature (1127)..(1127): n is a, c, g, or t
  misc_feature (1235)..(1235): n is a, c, g, or t
cggcgagagccgcgctaggctgtaagacctgagccgggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcagagtgagactctgtctcagtaaaaaaaaaataaataaataaaaatgtttaattaaccatgatatttgctttggtaaaacctttgaggtttaatgagaattttaaaattcattatacttttcttatggcataccatacctcttacatcaatccattctcacaactcctaattgtgcaggatcatcctaacaatccgctcaaacaacattgtcgccccactttgcacacactctttaaactcnggcaggcttttcaacgcgcccaaattgggcccaattgccacatttcccttatgggcgggctatacaattcacctgccggcttttacaacgcntcattgggccctggggtccccaacttaacccctttcgacaaacccccttttgccaactgggccaatatttaaaggctcgaacagtgcgcttttcaacactttgccacnctgtatcgccaggctattcccgcgcctacattttctcaaatcgcgggaaacttttgtaacctcctatttttccccatgccggatctggtcccttttaacccatgataatccgcgtcagcttgatgtttccaccttcaacatgacctcttttaagcgcggcgcccctctacaacgctgaacctctctacgcgcgtgccctcccggccctcctcttatcattctttgcgttctccctccatgactactctctccctcacggctcccctctatttcctctctcgctcctctctctcttgagcccgctacatctccattcactgcgcttacagcatcgtccctatcctacctctcttctctctcatctcgctctcctctctcgcgtctcccacctcttctgctcctactcgctcacccc

SEQ ID NO: 260847 - DNA, 1548 bp, Homo sapiens
cggcgagagccgcgctaggctgtaagacctgagccgggcggagaagcaaaggagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcagagtgagactctgtctcagtaaaaaaaaaataaataaataaaaatgtttaattaaccatgatatttgctttggtaaaacctttgaggtttaatgagaattttaaaattcattatacttttcttatggcatataaaagttttaatatttttttattgtctcaactaacatcataaatgtcttaatgttaaaatccatgggatattctatttaaaattttagctttatcacctttgtgctatcagagaatgtgctttgaactggtaaaatgagttaaagtattggaaaacacttatgtcagcagaggctcttaaaaatcattttcatccttcctcttctagtgatgatttttttttaacccatgttttcaccagtctaccaatccaatggcataaatgctcctacataggcaacttaagtgtttcttaagttgatgcaaggtattttgcatgaggctgaattcttgttgtcggagcagaggatttttgttccaactactgaattggcaaaatgttaaatataaaaacacctcaaaaagtcaaaggtagtctgaatgaaaaatttattttaaacacctcaagtaatctttacatttctacaaaatcataacatagttcttttccagaaacatttattcttaaaatctacttaagtgtttcatagaaactttagtaataaccagaataattcatgacactttagcaaactcttagcagcaagcagaaagaacttattaaaatatcctttctttacaca

SEQ ID NO: 260848 - DNA, 624 bp, Homo sapiens
gagagggaagctggaagcacctttggcccgggacagaaatctggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggtaagtcggatttataacttgtgttgatgcttttataatctaggagcttagggtttagtaggaagagtcgctcattcaatgaattaaacgctcattcctatgtactaggcaccattccgagtgcagtggctacaaagactagtagaacatagtcctggttctttaggaactctgtgattgggcaagtgggagagagggcggaaaacgtgaactggtgagtagttggcgtgtgatgcgtgccgtagtggaagaaagtg

SEQ ID NO: 260849 - DNA, 368 bp, Homo sapiens
ttctcatattcttagaggtgaaagcactagtcaggacgcttggctgtgattgccaacaactgccacattgtgttaatatgagcaagtcattaaaattcttagtttcggcttttccaactgtaaaatcaaaatgatgttacctgtatccattaagatactcttttgtctgcaggtcaaggaaaaccctaactccaaatgacttaaaccagaactttctaatggaagtataatatgaactatgtatgtaacttaaaaatttttagtagccatatttaaaaaggtgaaaccaattttaataatacattttatttaactcattatccacaatattttttttgtgtgtaaacaatatacaatcattaatgaga

SEQ ID NO: 260850 - DNA, 440 bp, Homo sapiens
gagagagagagagaaggcattttaagactggggagccgggtgcggtggctcacgcctgtaatcccaaagtgctggaattagaggcatgagcctccatgcctatcctagactatcttttaaaaagttttatttttaaagaagcagaactttctagtttgttttatcatgcctttatcaagaactttttaagaatttagggacaaaaacatcttatgctctgccccaatatttcatatgtagaaacataaacatcaaattttatatgttgacctttttttaaatcactgcctaaaaaagaactatattttgtggtcatgtgaagtttcagtggtagaattttctttctgttgtggccaatcatgaatcttgctccagtgtttttgtatttaccagacggcagctggggagtgagttagacagaaatataaagacagatatac

SEQ ID NO: 260851 - DNA, 220 bp, Homo sapiens
tctgtaaaacaactgtaaaggaataccaacaatctagtgcagaaattcttctgtaagaacaagctaccctgatgtcatgtcgtgttttaggactgtttgcttctcaacctgatgaagttgttcttagctgtttgctttgttttctcatccacagcagtattcctttctttgtatcttgagcaggcttgttaaatcccgtgggaggcttttttttttttta

SEQ ID NO: 260852 - DNA, 209 bp, Homo sapiens
gcccctccagccaaaaaatggagcacagagattcaaaatccttagagggaaatggataaaggtgctttccgttcatgtctcagtttttgggatatcaaaaatgggagtatgaagagacctctagaggtagattttgggagtacattcaggaaaatttcacaagcccctttcctgcctctacaaagccacttattaaatataaggactgt

SEQ ID NO: 260853 - DNA, 321 bp, Homo sapiens
tacttccttacccccaattcttgcctcaaagcctgtattacgttacccaattttaatttcttcaaagcatttatttcaaaataaaattccacatatttgtttacttctttattttctgtctttcctattaaaatgtaagttccatgagaggaaggatttggtcttgttcaccaccatatccccagcacccagaaaagtacttgacactgagcaggtggctcaataagcatgtgttaagtgaataaatgacagaggtatacacacacgcgtgcgcgcgcacacacacacacacacacacatacacacatgtaattttttgta

SEQ ID NO: 260854 - DNA, 879 bp, Homo sapiens
ggtgaagacggaggtgggttctggacagacctacgctgtcagggagtgtttacttcgcctacacttctgttcctccccgccctggtgctgctccaggtcacatactcgtcctgagctggcttcagcctctctgcacagaagtctcccggagccatggcctagtactcttatgtgaagtctaccaagcttgtgctcaagggaaccgaggtgaagagctgggtcctgcagctccggcgggagcctcctcagttcttttcggacgcactccacccccgcgaatccggtgggagccgtggtgcggagagccggcttcgtggcctcccaggcttcgctctgaccctgtctgggctggacggaggccggaccacccttcctggcgcctgtgcagagaggggaagcctcctgcgcggacgaccctggaaacaggatagacaggcgggtgacccgtggccccgtacccacgagtttgggtcccctgaggcatctctccaggcctctgcctgatttgcctgaggttgactgtacatacaaatattgagcatttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagaagatgaagaaaccagcttgatatgttggaacgcagctgctcaccagcaacggaacaaagctggacggagaatgactttgaagagctgagagaagaaggcttcagatgatcaaattactctgagctacgggaggacattcaaaccaaaggca

SEQ ID NO: 260855 - DNA, 450 bp, Homo sapiens
gctattccaggcagtttgttaggcatgagttataggcttgtacggccaggaatgaaattggtcagttctgcaattagaaggcaatgcttgtgatgttttatgctgagtggcctttagagcttaaagactgtcagctgtcttgtctgcactgtaacctcagttgccttctctgagcagggcacgctttctttaggaaattatggcactaacttggcaggtggtttcactgttcaagggctccagctcctggcacaagtgatctccagagttaaaattggagcagctgctgagacttgacttgctgcctgctttacctgttccctccccaaagagaggaagcacttttcattcattgccagtgtgtatgtgggagctaaacatatatagcattttagtaaatgccactgcctactctttttcttttccttttttaaaaaagttactgaggcg

SEQ ID NO: 260856 - DNA, 343 bp, Homo sapiens
ggcaaacataattacagtttattcgtacacgtgcacgcacacacaaatcctctacggaaaattatctttctcaccactcatccgaatataaacgtggacaatttatcaggggtaaatggtgaaggtaggataacgtcgtgatttcaattccttttcaaaccaaatacaagttttcctaaaatgggggtgacatgtccatgtaagaataccaaaaatggcactgtaagcaaaaatgtacctgtaatgttaaagatttcatgcgcctggaatcataaacactttgtaagtgtagtcttctatctagcaacccctccggacattattttccatttagaaaaagaag

SEQ ID NO: 260857 - DNA, 463 bp, Homo sapiens
tccaaacactgtgctcctaacaattatggtaagctgtctcctgcattctggagggtgtcaagagctgaaacccaacagccaacactgtaggactctccagagcctgttggggtacaggagaagcaggagggaactcctggtcaaagtagctcttccagttatataaaagtcactatctttttatgtttagagccagtggtactctgaccctgtcttgccaggctgtctgatttgaagagcctttactgatctctgatttggctttttctctgcagtaaaccctttggaaggtcagcaagggctccaaagaggactgtcatatcttagaacactccagcactaggtctgcctctgctggtgcctctaagagctgggcaagggtcttggggaccaaatccctgatggttaacccaggaaagtgaaagcacggggtgtgtagtacattctcaggaaagacatgtag

SEQ ID NO: 260858 - DNA, 272 bp, Homo sapiens
taaatcttgtcattccctaaataatgcactataacagcgatttacctagcatttacattgtactgcattaggtattataagtaacttagagatgatttaaagtgtatgggcagatgtgcataagttatatgcaaatactatgccactttatatcagggactgcagtatttgcagattttcaaatctgtggtaggtcctggaaccagtcccttgtgggtaccgagggacaactgcatatatatcatttatacgttaagcataataagcatcta

SEQ ID NO: 260859 - DNA, 422 bp, Homo sapiens
aaaaaaatccccacttaagtaaacaaatccggaaaacacaaccccatcacccaaaatattgaaatggaaaacaaatctacactctggagatttgatctgaaacataccagagctggaactgtgtacggtggccagaaatgtgttagtctgggcaaatctgtggccccgtagaggaaaaagctaacattttccaaataacaatgtgggcacgtaacaactacatacaatcatgtgctgttgttgcctaaacctgggaatagggttaggcagctccatatcttgacatagattccctctctccagcactcagtcatcctaaaaagcacaaggtgtgatgtctggaccaactctgggctgctctcagcccttatggtctctgcctcaggtgggctgcttctagggttgtgagcaggttttgaaac

SEQ ID NO: 260860 - DNA, 390 bp, Homo sapiens
tttcgttctcccatgttctttatcctcacagccctactcagccctatctttcagcctttcctttctcttgttctaatccccagccataaaaatttctcccagacatgtgaccatctcaagctgttttctgtctccatggctttacacgtactattcccccatctggaaaatcctttctaatcttgtctgcaattaggcatttatgattgtttattttcattatccatttacatgtctgccctccccacttaaccaaatgccttaagttcaggatcctgtgtatgatgcaactttgtttcttcatcccctggcccattaccaaacacataataaaagctcagagagtatttttggaatgagtaaatgaacaaataaatgaatacatggcta

SEQ ID NO: 260861 - DNA, 690 bp, Homo sapiens
gaagaagacagtgaataactaaacacatctagacatgataaaattttggtagtgatatacagttcaaaatgtctaaaatgttgttagttcaaattagtctgaatggagccattctatgtctgagctccccttcctagagttagtattattaacaccagaagtaaaatttttatctgttgttgttttgcttctgaaataaatgtcagtcctttcaaatgcctgcatactgtacatttttctcaattgccatattttctagttcaaataacagggcaagtgatctcataagagcattcattttgattttctatgtttgtgaatatattgatagaaagcatgacaaaagaaaaattaactgaaatttagctaatggtttgctcagtcattattgaaaagcatatacagataatcatggaaaatctagggatactgtatcattatctgggatctgtggcatttttctacgttgaactagaaagacggcatctatgtatttctatctttaaaagcagatcagttttagaaaatgcacaactttgtcaatcctataatcatattatgaactaagtaagagagaaagaagagagagttaaacaccaccacctgattagatagcatcatcaccttgctttaatgtaaacttttggtttagagaagcattattatgtaatgctcttagcttaaaaatct

SEQ ID NO: 260862 - DNA, 635 bp, Homo sapiens
aatgataggaaacccctctacttgttaaaaaaaaaaaacacaaaaacctcaaaaaaagctcttaagatctttatagtaggaagaaaacaaccaactgcttttcaaattatggggttggtcccatgttttgaaagttaccatctcagttgatctcttaatgagatgtctgtgtacatgagacaaaggtcgataagaacttgagggcttctcatctatcccttctcagttaacaatccagtagcttcagaagacaaatttaggacccttgcctttgtccactgggtgaagcattcatcatcctaaagctgcactggaaacttcctggaggtttgtcttctttttggaggaatgttctgatatgggattcactttgtttttctccttttgctttctggtgcatacatgttttccctcttatgttcatttcttaatcattatctgtaacattttggcttccttttcctctggctttgatttccaagtatggaattgaaccttcttgtctgaataccattatgtaagtactgacaacatcacatctttttattactgacactgaaggatgtattttttgtgggtagaaatggggtagagatgggataggtataattcttattaaacttatttttaatcta

SEQ ID NO: 260863 - DNA, 603 bp, Homo sapiens
gtagccatgaaagaaaacttgaggcccagatgacttcacttaaaacttttccaaatacttaaggaataaataataccaatcttacaaacactcctcctgagaatagagaatgactaaagcatcacaatttatttaatggagccagtatattaattgacctaaaacctaataaggaattaaaagaaaattatagaccaacttcttccataaatgtaaataaaaaattttaaaaatacacaagcaaatcaaatccagtgatacataggaaggataatattttatgatcaaactgtttattccaggaatgcaaggttaaacattcaactttcactcaatgtgcttgacaatagtaacagtaaaataggtagtaaaaactaagcaaactaaggataagaaaattttcctaatatcataaaaggtatctataaaacacctaactctaatatattaaaaggagaaataaaggatgactattgaggcaaaaatcttgatcaaaataccagttaaagcatattgaactgatttgacaccaaaacaactgagatttattcctgtaatacaaggatagttcaacatatgcaaattaatgtcatagtaacagaa

SEQ ID NO: 260864 - DNA, 174 bp, Homo sapiens
cttgactagcatctgggaactttaatggtaaacagttccctacaatgatataaaactttaactacatgaaaaaagtggcttggtatgcctagctgtgtaaaatgtggtttaacacctggttttccttctaggagtctagagttttgctaaagactgggcagagagtatttatgt

SEQ ID NO: 260865 - DNA, 525 bp, Homo sapiens
tcatcaagccagccttacaaatgcctccttgattcctcgagcctcatcattgaagggattgtggctgtgctccagggtattattcatgtctcactatgtaggcagaatgtcccagcccagtgctgggacagggaaggatgggaagacagggccattccaggaggcagaggccaaggtgtggaagatcaccaggcccagttcccccatccctagcctcggataatgcagaatcactcctttgttgttttatgggggtcttccctggcatggatgaaaataagcccccttctcactttcccccacatggctctccatctggggccactgagggggtatgcctacctctccccactgagccccacctggttcttttacccatccacactggcctccacctccagaaccctcgccaccctgatgtctgcccttttttccaaagttgggagaacaaactacagcccaagggccaaatctggcccaccacttgtttttgtaaataaagttttattggagcacagccacacg

SEQ ID NO: 260866 - DNA, 297 bp, Homo sapiens
gtacctttatcatttttttactattatttataagacaagtaagacatgccccctgcactagaggaattcacaggagagacagtctgattttgatttagtatgatgggccgatgcacttcaagagttactaccgttacgtactgttgcaagtcagaggagggaaaattaatcctgtttgttttttgaccagagaaggtcttacagggtagattggtcctgcccctagatacagcagtttatacccacacacctgtctacagtgtcattcaataaagtgcacgtgcttgtgaaaaaaaa

SEQ ID NO: 260867 - DNA, 465 bp, Homo sapiens
ttcatcatgttgcccaggctggtctccaactccttagctcaagccattctctcaccttggcctcccagagtgcagggattacagacaggagccacctcgaggggccgaccctcaccgtgtgtacgtgtgttttaacatttcctatggtgctaaactatttatgtttatttttgctgtgggatgatcagaagatgttcaggaacaagcaagaaaaaaaaatgagccaaatcatttaaagacgtgggaaaccaaaccaaaatcaaacccaaatcagaatgctcacaaaatttcaaccaaggtgtacacatcaaacataatattcagtcaggcatccagaaccaaaagtgaattcaccaggaaagacttgcctcatggacagaacataaattctttagaactcagagtcctcaaaccagaagggcactgctctttacaccagaaagtgcttgccaaaagcaaagaagc

SEQ ID NO: 260868 - DNA, 247 bp, Homo sapiens
tgaagtgggacctaatgggaggtgtttaggtcatgagggctctcccctcatgaatggattaatgctgccatataaagggtttctgggagtgggctctctctcatcctgccttccatcatgtgaggacacaacgtgcaaggcaccatcgtggaagaacagaatgtcttcatctgacatcgaacctgctgatgccttgacctcagacttctcagccttcagaactgtgagacaataaatttctgtttac

SEQ ID NO: 260869 - DNA, 271 bp, Homo sapiens
tgcctgagcccaggatgagacccatctctccccaccaaaaaaagaatccaagtggactgtctgttaacacaactaaagatataaagctggatatcaggtgagtgagtagatctctgtcactgctaccactctaatccaagcttctgtcatgtctcccctggattactataagagcctcccggttccagccctgccccgactccatggtctcttctcaacctaccagtcagagtaggtctttaacatgtaaatcaaattatatcactattct

SEQ ID NO: 260870 - DNA, 271 bp, Homo sapiens
agcccatagcaacactcattagaacggccaatatccaaaaccctggtttgcaaagaggaatgccctctccaaacatgcctatcgaataaggtcctgttcatgatgcaaatctctatgtgatcttcctccggaattcttgagcccatgatgcgaaatagcagtagctctcattcattgctggtggaaatgcaaaatgatacagaccctttgcaaaacggttcagcaacttcataggaaaagagtatgctgagtgttgttctatctcattgtt

SEQ ID NO: 260871 - DNA, 284 bp, Homo sapiens
tacgacccgtaggccggcgtccggtggagcccccctcagcaagattggcaacctgcaactccggtcaccgcacagccggcttcccttcgtgcacttagttcctacatcaaatgttatttctgtgcaaccttccttgtctctctaccgccttccaccctgtgcccttcagccgccaagtctgggtttctcctatgcatctctatcatggcacctaccacgctgtataattgctagtgacttacaaatctctcttatcagaatgaatttgactcatctttgcacca

SEQ ID NO: 260872 - DNA, 273 bp, Homo sapiens
aatgtgagctgcacaatggaatattactcagccttgaaaaggaaggaaattctgacccatgctaccacatggatgaaccttgaggacattatattgagtgaaataagttgtgaaaagacaaatactgatattcaaatgtgatttttctgagatttagtctgccatacttgggctggatgacatgccaagttccttcaaagctctaaagttagtgttcagtaataatatagtgttttttttttttttaaaaagacttattattcttgaaatcca

SEQ ID NO: 260873 - DNA, 541 bp, Homo sapiens
gaggtcctcatgcaaacacggcccaccctacaactcataacatgtgactgcaactaggacatcatcaacaacttggttaatgagtgtcgttaattcaaagagaatagaagttgagtcaccacataagaaaattagaaacgccccccaaatcttataggtcatgtacaaaagaacactaaatagaattatttcccaaatttgataatccagaaaacttataaggtaaaagaacttataaatatcagccatacaaggctgggcatggtggctcatgcctgtaatcccaacgctttgggaggccaaggcaggtggatcgaatcacttgagctcaggagtttgagaccagcctgggcaacatagtgaaaccctgtctctactaaaaacagaaaaaattagctgggcatggtggtacacacctgtgttcccagctaccagaaaggctgaggtgggaggatcgcttgagcccaggaggcggaggttgcagtgagctgagatcacaccactgcactccagcctgggtgatggagagagattctgtctc

SEQ ID NO: 260874 - DNA, 169 bp, Homo sapiens
ggatgagttcataatgagccctttagtgtagttctgactaaacatgggaaattgatccattcatcatttattcattcattcactgatttatgcctacattaaatgtttattgttatgtgccaggcaccatgctcaataatgggcatattgttgtaaaaaagaaaaaaca

SEQ ID NO: 260875 - DNA, 632 bp, Homo sapiens
acatgagttccttttagaatcataaatgaaagaagtaaaactttaagatgggaatgaataattgaaaagagaattatatttactattataattgatattattcgctattatgattacacttgtctagatcagagcccagcaaacattttttttgtaaagggtcagatagtacatagttttggctttgcagggcatgtgggctctattgcatttactcaactctgccattgtagtatgaaagcaaccacatacaaaatgtaaatggatgggcgtggctgcattccaataaaactttatttatggacactgaaatttgagtttcagttaaatttcatgtgtcatgaaatcttttgatgtctttctaactatttaaagatgtaaaagccttcttagctctcaggtcttacaaaaacaggtgatgggctaggatttggcctaatggttatagtttgttgacccctggtttagatcactgtaatctaccacagactattcagaagaatctgtttgcacacaggttcttttccctttagaagcttagcacctaaaaagtttgtcaagtcttcagagttgttcaaaaggaaaataactcatcacgtgcacttgatgatttaatcacttacccaatacaa

SEQ ID NO: 260876 - DNA, 430 bp, Homo sapiens
tagtttagaaagttctgtaatttggagcagagtgctatagttctttggggtatgtcttctcttttgcctcatccacttgccaggtagcagtggctttttattcttaagtcttagagatgcatttagagttacatacagacatatggtggaaaggggtcttgagttgatttggggcaaaaggcaaccgtccccatgcactagagatgaatcatgcctacctccctttgtcatgggaagtggcggccactgccacatctgctatgaggctcttcgccatcgttggctgctggaaatttggatacaggtaaatggtatataaggcttctttttgcttgtgcaccagaagtctttgtcccagcctccagatcagcagtcagtactcccctctcccaacctgtaggaagtacttgtgaaaagttatctatccctg

SEQ ID NO: 260877 - DNA, 294 bp, Homo sapiens
taaatagtataggtggtttcatttgagggttgagtgcatgaatgtgtgatgtatagcaaacaaacaaatcagaaagtgaatatttttaaaagagcttcgtattaattagtaagaacaactttagagtgtaactggcatcacacctgtaaaatgtaactaatcttttaaaatgagaactagtggctgatgatttatcttgtacatttatgtttcaggagctagaaaagaacattaagcactgaactacaatatatgtgttgccttttgattaaaagcaaatctatttttaagtga

SEQ ID NO: 260878 - DNA, 523 bp, Homo sapiens
  misc_feature (13)..(13): n is a, c, g, or t
  misc_feature (17)..(18): n is a, c, g, or t
ctgcaagtaaccntgannaaaggagaagaagggaagggaaaatcacacaagaagcctggaaagtgaggaggtagtctcagatcagatgcactgtggagcctatgtctagaagtgactctccaggggagctaaaatccatgtatttgggcacacacttgaacaatattgctagagaaatttaagcaagaacacaaagattgccggaggccagaaagtaagacaaataacagctcacctgcctggcttgttggagcaacaagaaactttaagagcaatcctccatttgccaggttccttggtaattagacttgtcaatagaacagatttctgtgtccataatgcataaggttaagtaaggggaagataactggaaagctgagctggagtttgaaagacaagatgtatttcaaacttcccttgaactttctccagtaagtataattgtgtgcttgttgtcaatccggccttagtccttgtcattacaggttcagtagctgcaaaggtgaaatgttttgacaaatat

SEQ ID NO: 260879 - DNA, 494 bp, Homo sapiens
tagagataaaaggtgactttcagaaagaaaaataggcaacagtgcaaaggtagtgagggccaaagaaacatcagggttcctcatgctttgggaaaatacaatgttctgcagggatcctgacatttaaatcaacaatttcaagcaactttaatgtgcttggcttgcagattgccggaggccagaaagtaagacaaataacagctcacctgcctggcttgttggagcaacaagaaactttaagagcaatcctccatttgccaggttccttggtaattagacttgtcaatagaacagatttctgtgtccataatgcataaggttaagtaaggggaagataactggaaagctgagctggagtttgaaagacaagatgtatttcaaacttcccttgaactttctccagtaagtataattgtgtgcttgttgtcaatccggccttagtccttgtcattacaggttcagtagctgcaaaggtgaaatgttttgacaaatat

SEQ ID NO: 260880 - DNA, 260 bp, Homo sapiens
tttgggggctgacgccattttacgcctcagcccgccggcacccaggctcttgttaaaacgcaccgcttcgtgttagctgttggggagctctcgggattccaaccgatacaagaacctttcaggttccttcttaactttgtgcctttgcagcgtgtgctgttccctctgtctgaaacgttattccccgcctcttcacctgattcatactagtctttcaaggctcaactctggttctgccacctcaaaaaattttgtttaaa

SEQ ID NO: 260881 - DNA, 512 bp, Homo sapiens
atgctcatcctgcatgactcctccttgagcctttgtattttcccagctagacctttcaggcttcctatttatacatttatctcgagtacaccgagtggtgacaaagatgcgaatcggccagcacattttcactcagtgtagagagaagccatttaaagactgagataacatttcaagaaaacaataaaacctgacaataagggaagatgagaaaaaaggaacattcctgactgtggttctgacattcacaatgtttccatctgtttgtttcactgaaatgatgttctcccgttcctgtttggcttattaaaaagtgtataggttaaaagatctgttaaaaatggtccatatctgtaaaattgtctggaaagttccacagaaagttacaagtttttttcctctggctgcaaatgaaaaataacatatgaagatcgttttaaaaaatttattcaattacttccagtgttattttatgacccagttatatatcaataaaattaataggaaaatta

SEQ ID NO: 260882 - DNA, 380 bp, Homo sapiens
cttccccaaagccaagccaagccacccaacatcacctcccagaatggtgcattggttacaatcagtgcacctcaggccaggcactgtggctcgcgcctgtagtctcagcactttgggaggctgaggcgggaggatcacttgagcccgggagttggagaccagcctgggcaacatggcaaaaccccatctctaagaaaaaatttttagattagccaggcggtggcgtgcacctgtggtctcagctactcaggaggctaaggcgggaggattactggagcctaggagattgaggctgcagtgagctatgatcatgccactgcactgcaacctgggcgacagagcaggaccctgtctctaaaaataaatacataaaacgcacc

SEQ ID NO: 260883 - DNA, 426 bp, Homo sapiens
attaatataaatatctatgcatgagggggaaataattgggaaattttatctcctctgacaaaggggaaaaaggccatttaaaaatattactttttccccttcagacagagagcagaggtgagccacacgaaatctaagttcgcatgaaagagcgatgataaaaaatgcaggtgctgtgaaacatttatatggaccaagtgtaagacagtatgtaggcctgaatttgaaatgacattttggtataaaacagatctcccaaaggcaaatttgaaacttccagaaaagtcttaaaatgacatctttcaaaatgaagaatcatcaaataaatatgcccaagtcattacctcgaagtacttttctaatgagacaggctgaagaaacagctaaaaataattgaccccagttttacagctgaaagttgtaaaa

SEQ ID NO: 260884 - DNA, 336 bp, Homo sapiens
ggtgaagggaacatttcaccccattcactcccttgtctttaactggtatcttattcaaacagatttttttcctgcaattgttaaaaatttcaaacacaaaacatcaaacaggatatagggtccttactgagccaaaggaaaatagaaaatgattttggattaagaaacttgctcaatgaagagatgctactttgagacctgcagaatggagtcaggaaaccatgagatttattataaggaaagggaaaaggaagggcccccgaccgctcctccatatgctaagacatttatatatgttaactcatttaaatacacagccactggattggataacta

SEQ ID NO: 260885 - DNA, 1044 bp, Homo sapiens
agtccacctgcttctccttgggcaagtcgttccaaaccatggcacttttacatcactcctgcctagtttagctctgtggttcctggaagctgcagatgccctactagtatacctgtagtagcccagacttccttatgtatcaaagttgccgcctcatgtccctcaccctcatgacccttgagttcaattgtcaaggaggtgaaagcataatagggttccaggtagtgcttgataaaggcaatatttggaagcaggtcaagtttacctttggtgtccttccacccactgctgccctcaacccacactgaggctctgttgccacctttgtttttccgggtctcagaaacacatcccaagctgtggacctttcctactttctaaacctgcccttgtctctttttatcagatctggtgccttcctgtcatgtcaccacaggtgatgactaatccgataaatgaattagttgtcctatgttgatgggctccttggttttactgcccttcccaggtaatcaggtaatgcatatatatatacatgtattttttaaagagacaggatctcgctctgttgcccacgctggagtgcagtggtgtgaccttggtcccctgtagcttcaacctcctgggctcaagcaatcctcccacctcagcctctcaagtagctgggactacaggtgcatgccgctatgcctggctaatgtttgtattttctgtagagacagagtcttgctacgttgcccaggctggtcttgaactcctgggctcccgcctttgccccacaaagtgctggaattacaggtgtgagcccctgtgcccagcagtaatacatatatcttacagttttaacctttaaccataaaatcataatggtgatgattcctagcactgtaataagttagctagggagatatttcaggacaaggagaactcattggtttcccttaaactacatcctgtaagtaactttctaggcttgaggcttacctctcaaccctcacttcctccctttattatctttattcctttgaggcccctcctaactct

SEQ ID NO: 260886 - DNA, 895 bp, Homo sapiens
gttaaatctaataaagtttatttgcacgagcgcacgtgcacacacacacacgatttatgaggcattcatcaggcagcagcacttaacagggagaggttcagagagctctacccagcactgtgggcaggcagtatttatagacagaaaaaggaagtgccccacagaaacagcttgattgcttacagttgggctagtcttatttgggcaggacattatgacgtatttgccttatatgcacatagtctgatcagttggcagcctgtgattggctgaagctcagctacttgtcacaagaatatactctcagttgcagttaatttacatactaagttaggttgcagttccctacatagcaactcagagtagggaggaaattttaggccaaatttaatttaaattatgttggagcatgaccaaagttggtcatgaccagaagctgaacacagatatggaagctaacacaatatccagtggagagagattgtggtagagtacatggggcgaaatggttgatttctgcatttttgttggtgacgccatcaggatttgctgaagaaccaaacgtgtgacaggaaaggacaacacaaggagctgccagctttggaaaccagttctactctcagtattaccttcgcaaaagatagagctttgtaaatttctagattcctcgttcttattatcctagactatttaaccagaatctccagggtcgtggtcctggaaacaatacgtttaaaactcttcccaaggatccttcagcagccaacttgactttggctaaggagtccgccagctctgggctcacttgggttgtttgcaaggaagagcccatgcccagagtataaattgggagaacagcgctgtgcaaagagcgtgggttggtgagctagtggat

SEQ ID NO: 260887 - DNA, 428 bp, Homo sapiens
actaaactcagaaataagcttaaatatcacgttattagggttgtttgatatacctgttccttagagtaagtggtgggtactaaattttgttattgcaaactctcttaaactattttagtgtttcagtgtagtaagatttagttgtgtttttctaaacaaaacccccaggaaaataagaaaacaaatctgataagacgtgaaagtagtctttccttagtaaaacttttcctttatgtataaaagtgaaatgaagcagagagtataaagaaaaactggtaactagagtaatccttaactactaaaaacttagaattatgaaaggcatttggttaatgaattctatgtaatgagagtaatgttctgagattagtaattgaacaaagtataaggttaaattgacttaaaaacattactgaggggccgggcgc

SEQ ID NO: 260888 - DNA, 527 bp, Homo sapiens
atgatgaagcaccttgtaccctaagattaaccaaaaataacagcgttaccctgtcaatttctggtcccaaaataatgaaacattgagtatttcttataatcccagatccccagcaaacaccattttattcttgacttttatttagctcatgttgcaagatctttctgaatatgatcatcatgtgataagattttgttttttctccatgaacaaattaatgcaaacttagtaatcatggtaatcttctttatatttttctttaaatacctgttatatttttcacttgcttatccagtttttctgaagtctgactcccttgaaccttttcaagtaaactctttttcttttcaaaatgctttggctctgactcttcctttgaaatttttggggaaaaaatgttctctgatcttaaaagggattgtaagaaaacatgaaaagcctctcactgttgttgatgtttcattaatttgttgctctgtttggcactgtcaatttaaaataaatttctatgcctctttcagcaatca

SEQ ID NO: 260889 - DNA, 594 bp, Homo sapiens
aagtctgggtctgtttagtaaacattattaatttgttcccttaaccttaaacatctagaggctatgaatgcctgactttctgggaatgcagcccagcaaggcccagcctcactttcctagccctcactcaagatggagttgctctcgttcgaacgcctctgatacaaaggtggctacaacctgcaggtacccctaatccaaataaggcaagcgatcactaagaacaagatagaaaaatccgttcatgtaaaccttgaagctctagttaaaatttaagtttaaaagcttgtctattccacagcccaatacaaattcgtaaactttcttaaaacattatgagatttttttttggttatttatttatttatttttagttcatcagctattgtgtggcccaagacaattcttccattgtgggccaggaagccgaaagagtggacacccttgatagtctgaaaactgtttagaccacctaatggttttattttttatttatttatttttgagacggagtttcactcttgttgcccaggttggagtgagccaatatcgcccactacactccagcctgggcgacagagggagactccatcc

SEQ ID NO: 260890 - DNA, 610 bp, Homo sapiens
agctcatttgggtattattgatgactctcctttctccttctgcaaccatctctctgcttcttttcccccaacatgcacagttggtgagttccaatatggatatttataagtctataacagccggcttcaaccttgttttcatccacatacacacaccccaacctgccctacacatgatggagatgtctccatcttgggggactcttgttaccaatgctgtccttgacttctaagatacctaatactaatagacatggagaaggctgggaagaagtggggccaccttacactggaatgggataaagaaccctattcagggccgggcgcggtagctcatgcctataatcccagtgctttgggatgccgaggctggtggatcacctgaggtcagaagtttgagaccagcctggccaacatggtgaaaacccgtctctactaaaaatacaaaaattagccacttagccgggcgttgtggtgggtgcctgtagtcccagctacttgggaggctgaggcaggagaatcgcttgaacccaggaggcggaggttgcagtgagccgagattgtgcacattgcactccagcctgggcaacaagaaagaaaccccatctca

SEQ ID NO: 260891 - DNA, 322 bp, Homo sapiens
gcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtgga

SEQ ID NO: 260892 - DNA, 249 bp, Homo sapiens
gcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcagtaagttcaggtagctgggactgtaggtatacatgatgatacttggctaatttttaaattgttttgtagacacggggtctcactttgttggccag

SEQ ID NO: 260893 - DNA, 392 bp, Homo sapiens
tgaggttgccggctggtgggatgcccgccggcatggcgaggggtgttcttcgggatccggctggcccagggcctggggctggctagagtgtagctgctgttggagagtgtggacagactcgggtccggttccatctttgccacctgtttgctgtgtgaccttgggcaggcaactcaccttctctgagcccaggtcatttgtgcaatgcagataacagggttgctgagggttcattcaatgacactgtgtttataaaaagtttagagcagactgggtgtggtggctcatgcttgtaatcccagcactctgggaggccaaggcgggatggtcacttgaggccaggtgttcaagatcagcctgggcaacatggtgacaccctgtctctctttaaa

SEQ ID NO: 260894 - DNA, 472 bp, Homo sapiens
aaaaaaaagaattgataattgctagaagaaagaaaaaaaggagagaaattatcatttgataaataaagatatgtaaaccttaagctaataggacatacatttttaccatatttcatataattttgtgtcttgtaaagaaagttaactagccctttctccatattttgctctaaattaagctatttttaattaatttttttgcttctttattaagcataaaaatagaacacatcccatataaatctgttttatagactggttaaaactaaacctgggtgaccctgtccttctgatcctccacactgatagacaggtaaagtgtaattgttctcgtgtctaaattgggtgaaggtatttgagtgggaatttacggtgagaattagcagtctttatgtaagcacctacagtcatatccacatatattatttttcaaaaaactttctcacaattgtgtatgggatttctctaaaca

SEQ ID NO: 260895 - DNA, 654 bp, Homo sapiens
aagagtaaatagtaggatgaacaagaaatatatgggcatggcagtcttcttctcagtgtaaggccataaggctccaccagactccatggatggcactagccaccaccaaccagtgattgaatctgcattacctgaaagagatctacagccacccacccaaaaaaggagccacaactatgttggcaagtagagattatgctttttgccccataaataaaagcaataggagaaaaatcgcaatgccaaaaaaagattgcagactgctcacctgatttagtgtaaagtactttgctcctggctggctcaccacagagctgaagtcagagggcttaggtgggccttcagatgccagacagaccctagacccagccaatgttccaggttcttgacactatcacaaaaaataattcagggatggatcagaatcatgcaaaaggcaaaaaaacttctatggcaaagaaaaagtaaacacttgaaagaagtgtgggcagactcaggagagtgagatgtgcaatggagtttggatttctaattttacaggctcttctaattagagggcggaataatcatgagttcttttaagaaaaagatggagatttcttagaactgggatgccaccatttttatactaaatctgggaatgtttggatctgt

SEQ ID NO: 260896 - DNA, 1419 bp, Homo sapiens
tggcggcgttcccggccggacaggcggggcgtcggggcgcgggctggggccgctgtcagtcagtccactggctcccgcgccgcgtctgtgtccgtcgctcggagggtggaagccggggtctcgcgggccgcgggccgcatgactcctctctgcctcaattgctctgtcctccctggagacctgtacccagggggtgcaaggaaccccatggcttgcaatggcagtgcggccagggggcactttgaccctgaggacttgaacctgactgacgaggcactgagactcaagtacctggggccccagcagacagagctgttcatgcccatctgtgccacatacctgctgatcttcgtggtgggcgctgtgggcaatgggctgacctgtctggtcatcctgcgccacaaggccatgcgcacgcctaccaactactacctcttcagcctggccgtgtcggacctgctggtgctgctggtgggcctgcccctggagctctatgagatgtggcacaactaccccttcctgctgggcgttggtggctgctatttccgcacgctactgtttgagatggtctgcctggcctcagtgctcaacgtcactgccctgagcgtggaacgctatgtggccgtggtgcacccactccaggccaggtccatggtgacgcgggcccatgtgcgccgagtgcttggggccgtctggggtcttgccatgctctgctccctgcccaacaccagcctgcacggcatccggcagctgcacgtgccctgccggggcccagtgccagactcagctgtttgcatgctggtccgcccacgggccctctacaacatggtagtgcagaccaccgcgctgctcttcttctgcctgcccatggccatcatgagcgtgctctacctgctcattgggctgcgactgcggcgggagaggctgctgctcatgcaggaggccaagggcaggggctctgcagcagccaggtccagatacacctgcaggctccagcagcacgatcggggccggagacaagtgaccaagatgctgtttgtcctggtcgtggtgtttggcatctgctgggccccgttccacgccgaccgcgtcatgtggagcgtcgtgtcacagtggacagatggcctgcacctggccttccagcacgtgcacgtcatctccggcatcttcttctacctgggctcggcggccaaccccgtgctctatagcctcatgtccagccgcttccgagagaccttccaggaggccctgtgcctcggggcctgctgccatcgcctcagaccccgccacagctcccacagcctcagcaggatgaccacaggcagcaccctgtgtgatgtgggctccctgggcagctgggtccaccccctggctgggaacgatggcccagaggcgcagcaagagaccgatccatcctga

SEQ ID NO: 260897 - DNA, 237 bp, Homo sapiens
gagggggagcaggcctgcagccccagaagcacccagagggcctgtgggtagatttgaataaaggtggtccatgggagtggcttcccagggagaaggcaagccccagaactggacagggaagaaagcaaaccatgttggactcgcaatcagtgatgatctagagcagaggtcatcaaaatacaggccacaggcctggcctgtcaccagttttttgtaaataaagttttattgaaacat

SEQ ID NO: 260898 - DNA, 134 bp, Homo sapiens
catttctctctaatgtgacgtaaagttaatagaccccttgaacagattcatcttgaaatatgaagatcaatcatccatggttcaggtcaaatacctgctcacacatatttactgagcagactagtccaaatttt

SEQ ID NO: 260899 - DNA, 453 bp, Homo sapiens
caactctcagggaactaacagtgagaactcactcactgctcaccaccctgcccccacccccactggcattcatctgtacatgagggatccaccaccatgacccaacacttttcattaggcccacttacaacattggggatcaaatttcaacatgaggcttggtggacaaacatccaaactgtagcagtacatttactgttatatacttgtttttgtttttagtgtgtgtaccctctaataaatttaaaagttaactgtaaaatagcctcagtcaggtcctttaggaggcattccagaagaaggcgttgttaccataggagatgacagccccattcaggttagcgttcccgaagactttccagtgggacaagatgtgaaggttgaagacagtgatgatgatcctgaccctgtggaggcctaggctagtgtgtatgtgtgtcttagtttttaatg

SEQ ID NO: 260900 - DNA, 460 bp, Homo sapiens
cgccgtcttaccctcgcgcccacgggcctgtgtgtggttgtgcacgtggcctgctttcctgactccccagagcactgcaggcagaggaggcaccagtggacagtgggaatgttcttggatatgaagccggaggacctggtttccaggtcccacttggccacttagtagccatgtggccttgagcaagtcatgtatccctccaagccctgaagatgatgaaagtgcctagttagttgagttgttacaattaagggataacatgtgcatgaatgtgccttgtaagttggtaaatgctataaaattggaagttttagaaatagtgggcactgatgttcttactaagtcagctctccagagtggttttcccatttttatcccccatgagggatctgtcatcagtgaaaggaatgatacaggattcctacgtgaagctagagacttgctaggacttcctccccac

SEQ ID NO: 260901 - DNA, 731 bp, Homo sapiens
acttatttttaaaagggtcatatgtacaaatatatagtccagaaaaattttaaatataactatctataaaagtatgtgacaaaatcccattcacagtcttattctccttccacagccacttttaattcatttcttgtatatcatttcagaatttatctttgcaaatacacatgtatattcttattctacccttctctctcaacacaaaaagtagcataccacacatacgataccattccttctcccttttaaaaaaacacacagaatacatccaagttctaggtgagtacagagtctttctcattcttcttttcagctacacagtatgcatcatttggatgtacctcagtttacttaaccaattcccttttggcagacactgaaatcatccctatcatactattacaggcaataatgccaagcataaccacctatcacacaccaagttcattgctgaatctgcctttgatgaagcctctgtttgaatcaccataacgtcacaaggctgaaaagttagccccttttttagttttcattatgtacagcagtatgtagcaaaagactccctcgggcaaaggaaatgtactctttggggatttacttcataacaataaatggataaacagaacaccaaggagaactgtttatatttaaccatgaacatgtatgtatacaatacatgcatacgcatagaaagtataaaataaataaattcatcaaagcattaagca

SEQ ID NO: 260902 - DNA, 627 bp, Homo sapiens
gcggccgcggctcctccccgccccgcgcgccccgattggcctggccgcgcgccagggccgagcctgcagcgcctccggttataagttgaagaaataagaccagtttccaaataaatgacaaagagcttggtattcctgcaggcatcagaatcacctggaggaggagatgctgctgctggtggtggcccagagaccacacattgagaaccactgctctagaaaaccatttgtctttgctgatggagaaacctggctctaatagaagggcttgtatgtgtccaggaagtctagtgaattcgaccatgaatccagacatggccagtggctaaatcctgtgggaagacactgtgcttctctctgacccatgaacactctgctagtcaagctctctgtcacaaagacaacttgaagagacagagtggacctcacagaagataccatcgtcactcttaccaatgcaactgtggtgaacaggaccactattattccttagatcaaaaggacagcacattcaacagcatcctcatggcatgccagcaatttgcataggatgttcacaattaaactttgattatctagtgctttgtggatgtattatgtattacagaaatctatttgcaacatgga

SEQ ID NO: 260903 - DNA, 757 bp, Homo sapiens
gcggccgcggctcctccccgccccgcgcgccccgattggcctggccgcgcgccagggccgagcctgcagcgcctccggttataagttgaagaaataagaccagtttccaaataaatgacaaagagcttggtattcctgcaggcatcagaatcacctggaggaggagatgctgctgctggtggtggcccagagaccacacattgagaaccactgctctagaaaaccatttgtctttgctgatggagaaacctggctctaatagaaggtcctctgtggacagtgagctggactgacctcacaaccctccagtatgtgcagtggctgagaatgacccactcccagcaactttctgcagccaaggggttaatcctccctgagctgaagcctgacatgggggcttgtatgtgtccaggaagtctagtgaattcgaccatgaatccagacatggccagtggctaaatcctgtgggaagacactgtgcttctctctgacccatgaacactctgctagtcaagctctctgtcacaaagacaacttgaagagacagagtggacctcacagaagataccatcgtcactcttaccaatgcaactgtggtgaacaggaccactattattccttagatcaaaaggacagcacattcaacagcatcctcatggcatgccagcaatttgcataggatgttcacaattaaactttgattatctagtgctttgtggatgtattatgtattacagaaatctatttgcaacatgga

SEQ ID NO: 260904 - DNA, 433 bp, Homo sapiens
aaagtggtttgctcaaatggctgatgctttggttttaattctctccacctggaccactctgcggggctgcttgagtctcctcacaagatggcgctggcttcccccagagagtaagataggagtggcagtgctttttatgccccacctttggaactcacattctgtcatctcagctacatgctgttctttagaagtgaactagcaggtccagccctcactggtgctagtggtagcgcaattgggctcacactttaaagggatgagtgataaaaagtttttcagacttattttaaaacccaccatatccctaaacttatcattgctgttagagggataaactctgccgactgatgaggctatattagttcttgtgggcagttaccagaaaatggcagaaaagattcctgttacaatttcctcccctgcccccccc

SEQ ID NO: 260905 - DNA, 385 bp, Homo sapiens
tgagatcccagaggccacagcctgctccctgctgtcctccatccctcacacaggctgaggagagaggccatccgagatgacctgcaaagccacctcactaagcagtctcagccccgtgtcgggggacatggtgtggtggctgcctatagccctcctctgcccaaaccctttcttctagcagattctgtaactggcaggtcacttttgagtattaggactcaaaataccccaaagtggtcttgtccactgcctgcaggcccatgttgggatgggagcgggcctggcttctccctctccacagcccagctcctctgttgctttggggcaggaggagagggagagacagatttgttagtaaatgtgccttctcatttgagttgctgcc

SEQ ID NO: 260906 - DNA, 333 bp, Homo sapiens
gccaccgcgcccggcctacctcttactatttcagtgtatatttcctaagatcaaagatattctcttgtataaccatagcacaaatacagatttcaggaaattgaatttagatacaatccttttatctaatacatagactatattccaatttcattcattggcacaatcataactttcaaagcagtattgttcctggcccaggagccagtccggagtcgaggattgcgttcagctgttatgttcctgtgtggctgggaagcgggtctcagacggtttcatctgtaaatgtcagtatcagcgtctaataaagataagcctctttttaagcagcca

SEQ ID NO: 260907 - DNA, 316 bp, Homo sapiens
tttttttttaattcttaagaaaagcagtgtgccagggcctgccctcacacttggagtgacccaggaggtgctgcgtgctgcctcactgggtctcactccagccgcgctttgctcctctctgttcttgcacttgcctcagtggcctctgcagcagagcctcatgccagctcttccctcttcttgggatgcccctgttatttttccctgcagtcttggagggccggctccttggtcattattcacatgtcatctctgtgccacctcctagactgctgacttgcccccacagcaacccccttctgtcgtcttctgcagg

SEQ ID NO: 260908 - DNA, 335 bp, Homo sapiens
gggaatcgcttgaacctggaggcagaggttgcagtgcgccgagatcacacctttgcactccagcctgggcaactaaagcgaaactctgtctcaaaagaaaaaaagaaaagaaagaaagaaatttgtgattctaagaaattgaaattggctcacacagttacggagctgacaagtccaccaccacctgcaaggtgagtcagcaagctggggcccaagagagccaacgtgtagttcccgtgccaacgtaggcagactcaagacccagggagaggtaatgtttcagttcaagtccaaaggcagcaaaaagctgatgttccagttcggaggccgtccgg

SEQ ID NO: 260909 - DNA, 377 bp, Homo sapiens
ttttttttttagatggagtttcactcttgtcaccctgctggagtgcaatagtgcaatctcggcccactgcaacctgggtctctcgggttcaagcaattctcctgcctcagcctcccaaggagctggattacaggtgtgcaccaccacgcctggctaatttttgtatttttactagagacggggtttccccatgttggccaggctggtctcgaactcctgacgtcaggtgatgcacctgcctcggcctctcaaagtgctgggattacaggtgtgagccactgcgcccagccgaaaagctgattctttaatgtctccaattgaagaggtattctttttttgcgggcggagagggtctcgctttgtcacccaggctgcag

SEQ ID NO: 260910 - DNA, 361 bp, Homo sapiens
gtgaccctcccacctcaccctcccgagtagctgggactacaggcatgtgtcatcatgctgggctaattttttgtattttttgtagagacaaggttttgccatgttgcccaggctggtctcgagctcctgagctcaaacaatcctcctgcctcggcctcccaaagtgcaggaattacagatgtgggccaccatgcctggcctactgtgtttttcaatgacttaaaatttattttaaaaattaccacaagtgtatagcatattcacacctttacaagtcatcatcaagtttttaaagaaaatagtattgtttgtgttgtattttcatgtaatttctatattgtttcaattctgcaatttgctt

SEQ ID NO: 260911 - DNA, 260 bp, Homo sapiens
cctcactggcctccttcccctaaacctataaccctggtctagtcctgagaaaacaccagacaaacccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagctta

SEQ ID NO: 260912 - DNA, 199 bp, Homo sapiens
gaagataatgtaaagcatgaacaagttaaggagagccataaaaaattttaaaaactcaattctaacttatagagatgaaaaatacaatgtctgtgaagaaagagggcctggatgggttaacaacacattagacactgcaaaagaaaagattagtaaacttgaagacaaagcaatagaaactatccaaaatgaaacagag

SEQ ID NO: 260913 - DNA, 320 bp, Homo sapiens
gtgaaacctcctctctactaaaaatacaaaaattagccaggcatggtggcaggcgcctatagttccagctactcagaaggctgatgcaggagaatcgcttgaacctgggaggcagagttgcagtgagctgagatcacgccgttgcactccagcctggcgacagagcaagattccttctcaaagaaaaaaacaaaagtgaggaagttgtaatcctcccccacgaggagctggcattcaaggtatgggagacaaataagccagctagttacaaacaaacctctgaataatctttattattattcataatctattcaattatt

SEQ ID NO: 260914 - DNA, 683 bp, Homo sapiens
ctggaattcagccttctcttgaaaaataaaatcagggattataaataagaaatttgcacagcagtgaacatgcaagagaatactcatttaataagtgccaacatttagttttctaataggcctaggaaacaacaacccagtggccagttaccctttgattcacttgcctccaatggttccgataacaaggatgtgatcaaacagccagcagctgatgagaagtgatggcttgtggatctgtttgtccacatacctattgatatattatcttcagcaaggtgcacatcctgactactggtggtataggactaccaggtcaccaaattggaaactaacattatgtaaaagattgtatcaaaacaaggacatttttacatttcctcatcatatgtttttcaaattagtgggtctgaggggatttcaaggagcagtatttgatttacttaaagaactttcttggttgtagacattgtacactcaaaaattaaaccagctgtggccagacacggaagctcatgcctgtaatcccagcagtctgggaggctgaggtgcaaggatcatttaagcccaggattttgagaccagccttggcaacacagtgagatcccctctctattattaataaataaataataaaccaaattaccagctgattactatcaacttcatactgcaagggtcaa

SEQ ID NO: 260915 - DNA, 563 bp, Homo sapiens
atggcctaagtctggaaaaactgaccttgattacaggcttgtttgtagaaatattgaaaatgaggtaaaaggagaataaagactttgaacctggcaagtatttcactgttcagttagttggattatctatatcagttttacgctgtttctcacattcgagctagaaggtgtcattgtgatgctataagtggaagtacaaaggctagaagaggcttaagagcattttacccaataaagtgtgggtaaaaggggtgtgggtgaaagtggatatggtgtaagctaaggctctgaggtattgtcaagaaggctaaggctctgaggcattatcaggaggctgatacctcagcatagcatttgggtgggctgctaggtctctagggagagtcaaaggctggggaatgacatgacgcctccccttcaccttccccctgcttaaaaaaaaaaaaaaattgggaatttggatctggatctgctaggacccaccttcaatagaccagggaggtttagacccttcaaaaagataaatagctggctgactaacattgagattagtgtggaaggaa

SEQ ID NO: 260916 - DNA, 467 bp, Homo sapiens
tgcctctttgtttattaagaattgtttacagaactctcaagcagcaaaggcaaagtacagaagataaataagagcaagctggccggtgcgtgcgactggatggacaacatctttacccacatgtctgcatcagctctgcgttgttcaccgacaaatcccgtgtctggaagagtcctggcaggctgcacgggctggagagagagcgagctgacaccaacaccaggcagagtccaccatgaaggcaagtggcagtgtcccaaggagagcccgctggccaggagggcaccgcaagcttggacacagcaggggcactggagatgggtccacgaaccgcgtgcgcagcccaggaggctggcacaactggtgtctgcatgaagactaggaacagctggcttcttatctcacaccatacacaaacatcaatttaggatacattaaaggtataaatgcaaagggcaaaagtacaa

SEQ ID NO: 260917 - DNA, 480 bp, Homo sapiens
tctccctcagagatgggaaccaatcgccgggaagaaaccaaggcgcaggcgcggaccgaggtcagcgtccacgcggcgctcgcgtctcccctctgcgcaggcgtaaggccacagctcgctcctgattaggcggccgatcccaacgagcgcgtggtgtctcgcgttgccgacccttgacaggaggcggaagatgcccttgggaagaggcgggagacgctctctcggctgacctacagtgctgtggctgtggcccacgtggtcgccttcgggcgccttctcccttctcagcgtttcattccccaggtgctgctgcaagaacagtttatttgtctggcccgaatgcgacattttggaaattttgcccttgttttaatccatatagtaggtgtggctgttaccccctaggaaagcatctctagaaatttataacacatgcacagagagctaaggtgaccatcaataaattcaggtttacccttg

SEQ ID NO: 260918 - DNA, 471 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcagtgagtgctctctaaccacagtctatgcagtaatatttaaggctgcaagcagtatttacaacagagggtacaagttctatctgaaaaaaaaaggagggactatggcatcaaacagcctcttcagcacagtgacaccatgtcagcaaaacttcttttggggtgaggaactgaagtccagaggggtttcttgaactgcccaaggacacactactatttagtgatacaagctgggactaaaactgaggtcccccgacacctggtccagagttctttctactatacatcaaagaatatacaaataaaagtttatcataactaacccaaaaacctcca

SEQ ID NO: 260919 - DNA, 436 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttggggtgaggaactgaagtccagaggggtttcttgaactgcccaaggacacactactatttagtgatacaagctgggactaaaactgaggtcccccgacacctggtccagagttctttctactatacatcaaagaatatacaaataaaagtttatcataactaacccaaaaacctcca

SEQ ID NO: 260920 - DNA, 646 bp, Homo sapiens
gttagataaggatgaaattttcatttggaagaattcttacaatataaaagtaacatgtaaacaagattttttcaatgttattgctatttatccccaaaactcccaatttttaaaaacgtggtgacattataattactaagcactactgagctgtgaaatctggcatcattatcatcaggcctgtaactctgaaaaagtacatgacaaggcaagaaatatataaatgggtaaagtaaggaagaactcagagaactcagtgaagactctcaaagtgcatttaaattaattaaaattcttaagaagtttgttaaaatacctgtaatgtcaactgaaaagatttcactttcaaatttacaggctgcttgagttcaataacctaaaaatgaaaaacctctggaccattccagtacaggttattcaaaggagctgtgataaagagcatatagcaaatgtgctcagttatatgcactaggtgaggaactgaagtccagaggggtttcttgaactgcccaaggacacactactatttagtgatacaagctgggactaaaactgaggtcccccgacacctggtccagagttctttctactatacatcaaagaatatacaaataaaagtttatcataactaacccaaaaacctcca

SEQ ID NO: 260921 - DNA, 349 bp, Homo sapiens
gtagtaatgccagagtaaagccatgacatctagttaacttttaattttagatacacaatgaatgtcttttttcaaaaaagtgtgtatccctgtaatcccagcaatgtgggaggccgagacgggcggatcacgatgtcaggagatccagaccatcctggctaacgcggtgaaaccccgtctctactaaaaaatacaaaaattagctgggcgtggtggcggaagcctgtagtcccagctactcaggaggctgaggcaggagaatggcgtgaacccgggaggcggagcttgcagtgagtggagatcgcgccactgcactccagcctgggcgacagagcgagactgtgtctca

SEQ ID NO: 260922 - DNA, 423 bp, Homo sapiens
tgttagacttttttaacttaaagaaaatatgccctgacttttccctcaacattaactgatttttttccctatggttgaaaaatgcttctaatgggtagaatggcaccatttggaattttaaatatccagttttttattagcagtctgatcttagcacagtagaactggctggagagtcaggtgacgtaaaagctagtttcattatccactcttggctgctttgtgacctatggcgagtttctgaacttctttgggacattttgtttatattgttgtttttttcccctaatttaaacagcagtgagtttgtgagaaattggcagatttcacttcttgatttccatagacttccatacatcaggactcttccgtttgaaagtaactagttgatatttaaaaaaagaagaagaagaaaaggaagtg

SEQ ID NO: 260923 - DNA, 294 bp, Homo sapiens
aagcatggggcactgtgcaccaggtatgcttatcatgcctgtgaatgagggattgattaactgaatcctccagggacacttgggacagctctgcccacaagaagagcaagaacccaggcatcaatggggtggtgcagacatgggctcagggaggccctctgccatcccctcctgcctggaccaatgttttctgagaggcagaaagtgcagggtgactcttcactgtggtatttgtctatgtgtgtatcaagtgtgtaaaaatactgtgctctcttagtcttgatttatcactgc

SEQ ID NO: 260924 - DNA, 414 bp, Homo sapiens
tataaaaacactttgctgtgaatgtaatatatggttgtgtattttccataaaatatttcgctttcaagaaggggagagagtagaaaaaaaaatccttagtttttgacttaccttttaattttaggattttatttgaaatacatagtagaatggttttcctttgtgttttctttcattgctgtactctttcagagattacctaatttttaattgtttacatctcttttctttttaaaaacgtttaactctttaatataatggttttttttttggcctgcttgccttcctcctctcctttcctttcctctcctctcctctcctctcctctcctgtgctctcctcttgttctcccctcccctcccctctcccttcctttctttctacaacagagtgagactctatctccaaactgga

SEQ ID NO: 260925 - DNA, 296 bp, Homo sapiens
cccggctcacactcaccacagcagggcagacagcaggagtgccaaggacacctacttgcaggtggccaacaaaagaattacagcaaaaatgacagggaggaggaacaggagggctagaagtggcacctggctcatgcagggttaggacttgggacctcagggatttagcccaaacctcttattttatggccattgtcattacgccctctagagcctccaccttagctcttatgttgaagactttatcctgcgcagtcccactgcagcatgcgaaatcacatgctcttccatctggg

SEQ ID NO: 260926 - DNA, 389 bp, Homo sapiens
ctacacaacaggagttcaatcctaggacctgagctgatgtaaatgaagcaccgccaggcccagttggggaggaccttgtgttcctgctggagagtgagagtccctccctccccattccactcccaagagcagtgaagagtcaggaaggtgggcttgttttgttttgttttgttttgttttgcttgttgagcaagggaatgcggttcccctgtgtcggacttgtttcagaaagacaatgtcactgaggctggggcagggagattagctgagaggctcttgcagttatctgggaaggagctgtccataaaggcctgagttaagacagtagccctttgggttcgatttagtggtggctccccaaaagatatgttcactggaacctagacatt

SEQ ID NO: 260927 - DNA, 294 bp, Homo sapiens
ggtggggttagtgccagggctgtggaaatcatgaagaagttcctgtgtctgtttgtccctgatacatctgtctacatcctgctctgcctctcattgcaaaacactcaggggaccattacttaactctgtgtgggactttctccagcaatactttctctcagaccattcatatatatctccacggtgatgatgaagagaatgatgattatgattatgatgacaatgaaataaaagggtcccagaacactgatgagtgactagcatgtagtaagtgctcaataaataattgtcaag

SEQ ID NO: 260928 - DNA, 197 bp, Homo sapiens
cctggcccacagttccacagaggaggagtgtgtctggacagtccagccctgctcagatccctcccttgttcccagcgcctcttggaccaggggctccaggtacccgtgcgctagccccacacacctctgcacccctgtctgcctacagtccccaggatgccagccacatgcacatcccccagggccacgctgttccc

SEQ ID NO: 260929 - DNA, 495 bp, Homo sapiens
accatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattaaattattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaat

SEQ ID NO: 260930 - DNA, 438 bp, Homo sapiens
ggaattcttataattcaggaactccccaaaccattaacattcaaatacctctctcactctgctttccaagtaatcacaaaataatattacaagattactggcattatcatccactctcatgaatccattcacttaagtcaaaatcctggcacagataggacactagtgacttgcgtgctgcaacctggagagtgactctggttactgtgagcacagactttagaggaggaaaggacaatgggagcaacagcaaatgctactctgccttcttatcctagagctttttcatcaaattgggaggggcagaggagttaaggacactgaaagtttctttccaattgtcttgttccgatatttctcagccgtttattcacatcattctcaaacatctgattatctcatggtagacaattttagctattctattatcaagccata

SEQ ID NO: 260931 - DNA, 211 bp, Homo sapiens
gtttctcaatttacatttctaatagtcaacaaaaatgccataaggtataagtaagaactctttaacaaaaagcaagactacatttgctattcttaggctgacagtcactgtgagttgtttcaaatgcggaatgtgacaaacaacagaagtcccctcaacctctgtactcttaaggatttgctgaaagaaatctagtgctaccattaatcac

SEQ ID NO: 260932 - DNA, 109 bp, Homo sapiens
gttagaagctggaaagggggtgttagtctaagtactagggtagaacaaaggaggttacaagatgggcttaatagagcttggcagatacaggtagtagacaaagtgagag

SEQ ID NO: 260933 - DNA, 600 bp, Homo sapiens
ggagaatcgcttgaaccagggaggtggaggttgcagtgagccgagatcgcgccattgcactccagcctgggccacagaacaagactccgtctcaaaaaaaaaaaaaaaaattttaccactctttaaaatcaagtgggactggaaggatggtatggagattttattggtaagggcatttttcagaaaatataatttttgtggcctattgcttaattaaaatttcaacgtaaattctatataaataaataccaaattttgtttactgggtacctatcccagatattgctcttatccatgtaataccttacgtaaaattctgactcatttgtttatattactaaattcaccccaaatttcacctcattcaggatgaggtaaaaaacaaacaagggccaaatgctgtggctcatgcttgcaatctcagcacttctggaggctgaggcaggaggactgcttgaggccaggagttcaagaccacagcaagcaacatagtaagatcctgtctccacatcccagcactttgggaggcagaggcgggtggatcatgaggtcaggagttcaggaccagcctggccaagatggtgaaaccccgtctctact

SEQ ID NO: 260934 - DNA, 182 bp, Homo sapiens
  misc_feature (16)..(16): n is a, c, g, or t
  misc_feature (26)..(26): n is a, c, g, or t
acagaagggacggctncgagaagacnacagaaggggcccacatcctgcagaaccaggcacgaggaagaaggaagactttgaattttaaacagataaaaatggatgctgtttccatcgtttggtgtcctgcttttctacgtagaggaaacatttctcagcacaattaaaacgtgttcgtatgc

SEQ ID NO: 260935 - DNA, 468 bp, Homo sapiens
agagcacggaggccctttacataaacagaacaaatccttttcagtgcttttagaccttaacaaacatggggtgatgtacaaaactgcactccccccactataaggctagcccccaccctacaaacccctgaactcttttcagcatttcttaaatctgttccattgaacaatctgcgttcattgtaacaaatacaatctcattgaattagattctgaagagactttatagtagaggaaaaaaggagactgatcctgtattctctttagtttaaacaaggaacagagcacagcaaatgagaaatcttgggtgagctaagttcactggaatgggtggggagggatggggaagaggaaggggggaaattggagagacttgtaccagataaggaatccatttctaggtgtctcagaaacaaaaaacccagtgttaatgtctgtgctttaattacatgactgttaggtgtcact

SEQ ID NO: 260936 - DNA, 344 bp, Homo sapiens
ggttgccacttcaagggactacatcatgatgtcctgtttctaatgacctcccaatcatcctgcagaagattcttcaaatggggatcaacatgtccttatttaaggtttgtgatgaagaaataaacaatccccagttcctgccctagagaagctcattgcatagaaaaaggaacaaggcagatatacatgccacagtacagtaatgagacaacataaatcacaagcaaccaagtccaaaggttctttacacagccaatagctggtgctacaagcagatcaaaaccaggattgatggtaatggaagaggaacagactggaagagctggctcttctggcagtttttt

SEQ ID NO: 260937 - DNA, 659 bp, Homo sapiens
aaagaagatgcccattgtgtgtttcatttgcctaaaggctctctagctggtgatctgatttccaagaagggaaataacttgcactgtaaactgatttattaaaataggcgctcatgatccttatcttttagaagccaacaattttaaaaatatgctacagagagaaagggcaattgaaatgacaagaactaacagctcagtattttgaaaacatcagggctctgaagaagaaggggagattttgtagtgttgtacattgaaagtttatctgaaacattcccccatctctcttttcctctctctttgtccctctgtgccacccctaatgtattcacttttttctctactcactccctcgcttccaatatttaagtctttaaaaacattgaaataaaatgcaatggacaggacccgtatccgtcagttcttgttctcttcccctgaaactgggtagcacatcttgtcgttcctgtcagaccacccagctagaagtcccctctcctctctctgagacctgatagcattttgtgtccctctgatacagcacagatgaagtcaccctggattgtagtcatcatgtgtgtgatttttatcccttatttgcgtaataaacccttaatagaagagactgggtttcattcatcccccagtagccacag

SEQ ID NO: 260938 - DNA, 430 bp, Homo sapiens
tggattatatatcagacatctttgatttaagtcaagtagtgggtagagacccaagattcagtcccgttaagaggaggtatttgtttaaaaaaaaaatacattattatgtctggtatggtttagctgtgtccccacctaaatcttatcttgaattgtagttctcataatccccatgtgtcatgggagggacccagtgggaggaaagtgaatcatgggggtggttatccttatgctgttcttgtgatagtgagtgagttctcacaagatctgatggctttataaggggctttcccccctttgctcagcgcttctccttcctgccgccatgtgactaaggatgtatttgcttcccctcccaccatgattgtaagtttcctgaggcctccccagcccagcagaactgaatcaattaaacctcttttctttatat

SEQ ID NO: 260939 - DNA, 586 bp, Homo sapiens
cagggattcaatgaaagagatttatgttatatctgcaacagagaataaaggatagaattagtatttgtctttaaataataaagttaaaaggtggtaactaactgagatttttaaaaattacaggttgaatagctgatgaagcagaaagtgggaattgtagagctcagcttgggacttgccagtttggcagtgtttgtgatatattcaggtgcagacatctagtaagtagttggatacaacaggttgaggccagggaaaacattattgtaaataaaaccaatggaatgggtaagagggtagaaggagttctgcaacagaccagatgtttgtgttcccccccaacaagttcatacgttaacgtcataacctccaatatcaggaggtaagggctttgggagggtcatgaggatgaagccctcatgaatgggattagtgaccttataaaaaggggccccagagagctctcatgtcctctttctgccacatgagaacacaacgagaagacagcagagtgtaacacagaagagggccctcaccagaacctggctatgcaggcaccaggatctcagactttagcctcaagaac

SEQ ID NO: 260940 - DNA, 1061 bp, Homo sapiens
cggggaaggccatgcatcatctgctaccctggaggatctggagccagtaccgagaactagcagtggccctgcactcaagctccgcaataatcagtcaactcagtgaaaacatcaattcactgctgaacccctggccccagagcccccagcagggccctctgaggtggagcagctacaagatgagaccaaccacctaaggaaggagctggagagtgtgggaagacagctccaggctgaggtggaaaacaatcagatgttgagtctcctgaacaggagacaggaggagaggctgcaggaacaggagaggctgctggacaaggggtaggagctgctggaacaggagaggcttcaggagcaggatgagaggctgtggcagcaggagactctgtgggagctggagaggatgctggagctggagtgggaagccctctacaagcagcaggccgagccccacagcagctttgaggagctggaataatgagaacaagagtgcactgcagttggagcggcaagtaaaggagctgaagcttggagaacctggaagctaccagccagcagaaacagcagctaaagcccagttgagcctcatggctctccctggggaaggatatggaggaggacatctggacaatgaggaggaggcacctcggcccatgctgaacattccaggggacctggagagccgggaggccatggtggcatttttcaactccgctggagccagtgcccaggaggagcaaagcgtgtgctgccagcccctggctcacccagtggcctcatcccagaaaaagccagaggcagcggccccagccccagagactgggggtgaatctgtgtgtggggacacccactgggccctgcaggaggccatggagaagctgcagcaactttatggaaggagaagatggacctgaaggagctggtggagaaactagagcttcagttcatccacctctcaggacagacagacaccatgagaaagtacatcagccagggggcagtgccaaagacgcagcactgggagaggaggacatcgtcaggctggcccaggaccaggagga

SEQ ID NO: 260941 - DNA, 641 bp, Homo sapiens
gcattgtagctggtacctatctggtgagggtcccagactgcttccactcatggcagaaggggagctagcatgcgcaaagatcacatggctagagtgccaggctctgttcaacaaccaattttccagtcaactaagaatgggaattcactcccacaagaatgttttttttgggaccaaagaaaccacatccaaaccatagcagtgccccagccccccgagttcaaaggtcagctgtatagtgtacacaggaaaggagtgcataacccagattgggatggatactcaggaaaggcctgtcagacaaagtggtctttaaatacatttacctaaaggattggcaggaattagcctgagggagaggagagagaagacaccttaccagcctgaaggaagagctggagaaaaatcggtgaatttggcaaattttaaatagtattgtagtgtgtatgtttttgttgggtggggtagtgtagataggtaggcaagaacttggttttaaatagtttttataggccgggcgtggtggctcgcgccagtaatcccaatactttggaaggcagagatggtggatcacgaggtcaggagatcgagaccatcctggctaacatggtgaaaccccatctctactaaaaatacaaaaa

SEQ ID NO: 260942 - DNA, 395 bp, Homo sapiens
aactaaatagccccactcaggccaggcctatgtatcattataacagaattacttttttcacccttccctttaaaactaatgatcttcaagaagacttatgttttactcactaggttctgctcctatatgcaagatcctttcaggcttttaagtgctagaagccactccctgtttactaagtatgacgttagctatgtgcctaagaacagactgagccttagtccctacgtacttagtagagctccttacttagacattaaataacagatgttgaatgaaaaatcacaagtgaaaaagtatatgcctaatgcttggtaaactatttaagcctacaatctaatactctgatttcataatctgacagtgatcataaacttttaaaatgttactcaaat

SEQ ID NO: 260943 - DNA, 480 bp, Homo sapiens
aaagtaacatctacagaggagtaaacattccaggggtgcctgcatttgacagatctgttccctggggtgaatgtttaatctagagtgtgggaaggagctattcctccatagtatcagcattcctccttactttgctatgtcctccctaacactctcattcccatctttgctgttgtttcaatcaataacaaaagaggccaggcgcggtggctcacgcctctaatcccagcacgttgggaggccgaggcaggcggatcacctcaggtcaggagtttgagaccagcttgagcaacatggcaaaaccccgtctctattaaaaatataaaaaattagccaggcatggtggtgggggcctgtaatacaagctacttgggagactgaggtgggagaatggcttgaacccaggaggtggaggttgcagtgagctgagatcgcgccgttgcactccagcctgggcctaacagagtgagactctgttta

SEQ ID NO: 260944 - DNA, 416 bp, Homo sapiens
gtattttgttctttggcaggaattgtgactgtgagatgatggtatgtgagaaagcctggtttctttctttggatgttgcaataaattagaagcatactatccaaagagtgtgtcttctctcatgaatgtcttggctattagggctggctggatagtaaatgtaggagaagccaccacaagatgggcattctcgcacccatgacaggcaagactttcaacactattcccacaggaagagtgtcccctggaccctgatgcagcttcttacagtattctaaccctaccccggtaacgaccattatggaatgtgcacatttagcttcaacgtggctagaccaggttgagccaagtagatgggaacataaggaagaattataattgccattatttgtagacaataaaactgcctacctgta

SEQ ID NO: 260945 - DNA, 524 bp, Homo sapiens
caatgtaagttctgttgtccaggaatgcgttctcaacacagcggtttcctgaatgccccaagagagtggggcagtgagaggctgaaggccagacagcagggttacctttcctgttctgtgcagacaagattcattactccctagtgatgttttaagtgaatgtatagcattcattcatagacaatgtctagttaggtaatgttagcatgaagggtaaattctaaatgtgaaggaatatacacatgactttgactaatcaacatactatccctggaaaacatgttggaactgcaaaaacaaaacaaaacagaaaaatagagtgaagtgattcagaggttgtgaaaccctaaatttttaattaaaattgcacaatgcagttctatcgtgagcacaaactggattgaacgcctcctacatcaaaatcattctcaaatgtttgaagtctgaataactagtaacaagataaagatggacaactagactctttggattaaatgacaaagttaccaactcaccctactgtt

SEQ ID NO: 260946 - DNA, 1526 bp, Homo sapiens
  misc_feature (1)..(1): n is a, c, g, or t
  misc_feature (48)..(48): n is a, c, g, or t
  misc_feature (242)..(242): n is a, c, g, or t
  misc_feature (245)..(245): n is a, c, g, or t
  misc_feature (248)..(248): n is a, c, g, or t
  misc_feature (322)..(322): n is a, c, g, or t
  misc_feature (415)..(415): n is a, c, g, or t
  misc_feature (551)..(551): n is a, c, g, or t
  misc_feature (715)..(715): n is a, c, g, or t
  misc_feature (750)..(750): n is a, c, g, or t
  misc_feature (761)..(762): n is a, c, g, or t
nggaaagaatccagcatgaatattattgaactggagattcctgaccanaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagnagnganctatggattagattctgtaaagaaaaagtgccttgaatggcttctaaacaatttgatgactcaccagaatgttnaactttttaaagaactcagtataaatgtcatgaaacagctcattggttcctctaacttatttgtgatgcaagtggagatggatgtatacaccnctctaaaaaagtggatgttccttcaacttgtgccttcttggaatggatctttaaaacagcttttgacagaaacagatgtctggttttctaaacagagaaaagattttgaaggtatggcctttcttgaaactgaacnaggaaaaccatttgtgtcagtattcagacatttaaggttacaatatattatcagtgacctagcttctgcaagaattattgaacaagatggtatagtaccttcagaatggctgtcttctgtgtataaacagcagtggtttgctatgctgcgggcagaacaagacngtgaggtagggcctcaagaaatcaataaagaaganctagagggaannagcatgaggtgtggtagaaagcttgccaaagatggtgaatactactggcggtggacgggttttaacttcggctttgacctacttgtaatttacaccaatcgatacatcattttcaaacgcaatacactgaatcagccatgcagcgggtctgtcagtttacagcctcgaaggagcatagcatttagattacgcttggcttcttttgatagtagtggaaaactagtatgtagtagaacaactggctatcaaatacttatacttgaaaaggatcaggaacaagtggtgatgaacttggacagcaggtttctgaccttccctttatatatctgctgtaacttcttgtatatatcaccagaaaaaggaattgaaaataatcgccacccagaagatccagaaaactgaagatctcatcagttggaaacagtagcactttgaaaactttcaggccagctttaatttaatggccctactgatattcacatctaaggtgactaacaatgacaaaggccttatgaactgtacggacaatacagaagactattcttatcctcattgcatttctatgcatatacaaaaaaaaccattttaaagccaagaaaatatctgtcaaaccatttctgtcagtacgatgtcaactcatgcttttaattcagcatcagcagaaaatgactgtaggtaaatctcacatttatctgcacaaaatatagatttaatttttagcttaaactttgtttctacttagtagtgaatcgaattccccggcg

SEQ ID NO: 260947 - DNA, 644 bp, Homo sapiens
cgaacatggtgaaacccagtgtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacccgttttgtctgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagcca

SEQ ID NO: 260948 - DNA, 1236 bp, Homo sapiens
cacagggcagccccgacaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtctggcaggtcggggtcaccagagccccaatgcccagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggcacctgggctccaccagcccagccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctccgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcggctgtttctaaacccagacactgtttgtaatagactggaaataaaatgttcttttcttacaaaat

SEQ ID NO: 260949 - DNA, 500 bp, Homo sapiens
tggctgccgctgctttaatacttttagaggccctcaaaataggtagaggcctttcctgcagggtctgagaaggccaccgcagtcatttcttccattctgtcagacataattcctcagtttagccttcccacctcaatacagtctgataacagacgagcctttattagtcaaatcagccaagcagtttttcaggctcttagtattcagtgaaagctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctatcctcagaatgctacagggtacagcccatttaagctcctgtatagacgctcctttttattaggccccagtctcattccagacaccagaccaacttagactgtgcctcaaagaaaaaaaaaaattgtcatccctactatttt

SEQ ID NO: 260950 - DNA, 403 bp, Homo sapiens
ttcagtgaaccgagattgcgtcactgcactctagcctgggcacagagtgagactctgtccaaaaaaaaaaaaaaaaaaaagcaaaggaggagtagcctagccttaaagagccagggacttgaacactgtcattgctgtcatttctctctttctttctcagctcttttctacatgctgccttctttcttctggctttctccattgagggtgcaggcatgatgtcagaccactcctcacttccatccttgcagccctataaccagacaattaggagcaaagcgttcttgattggttagggaagcatgccaataggctcttctaggatcacgtgaccttccctaaactgatccctgaatgcccacccttaaacctgagtcatatgcttacctctagctaggggtct

SEQ ID NO: 260951 - DNA, 698 bp, Homo sapiens
gttgaagtggggggatcacttgagcccaggagttcgaggttacagtgagctataactgcactcgtcctttctttggttgacagagaaagactctgtctctaaaaaagaaaaaaccaagactggtagttctggccctcatggggtcaatcatccagctaggcagccaagactatcagtaacaaaagatgccgagggataaagtccagagcagcagaatcccagggctgcagcatctcagtgcttaccccaagcattaaggcccagagctgctcccgttggagcataggttcatagccccagctcccctgagccctgcacagctctgtcccctgagatggggatgctctccactcatcactggcacaagccacctgagtagcaggcaggtatggtggctggtggctgcagcaaattctgacctggcagttgtcctcaacccctttctcccttccacagacctacaggccagaaagtacatgtctttccaaaatgtgtcctagtaccccaacccacactcagtattgagctcctcctacatctgccaggccatggatctatactaagtaagtgtccacccaggcctgtccagttgctgcagccaattcaggcaccctcctctcagattctggactcttcaagacctgagctgtagccttcctgcaacacagtctgctggcatctgagggtgaaggggcttg

SEQ ID NO: 260952 - DNA, 429 bp, Homo sapiens
aacaggtaagtcaaatttaacagcaggtaacacatagaaagcagctttctgtttgaaatagctgagttcgtcaattaaagacgtacaaatatcccaactttaagaaaattttgaaggtttaaaaatgtgtggatgtacaaagacgttgaactttgaaatacatcaggttgatatgcataacctcaaaataccaactcctatccagccaaggtcaagggaatatcacacaaataggggagaattaggtaattgcacaatagactgaaatgaactgattgaaggagggtttactgaagcatgggggtaatgttggatattcaacataggcttatttcctgtgtgtatatgttgtgttgagctgtttctcttgtagaaattgaagtttaaggtagttcttgtgtagctttgagacagtgccctaaatgaaga

SEQ ID NO: 260953 - DNA, 545 bp, Homo sapiens
gcaaaaaaaaaaaaaaaaaaaaaaaaaactcgtgccgaattcggcacgagctcgtgccgaattcggcacgagcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260954 - DNA, 483 bp, Homo sapiens
gggggcccagcagccctcagccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260955 - DNA, 834 bp, Homo sapiens
gggggcccagcagccctcagccctccaggacaggctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaaaaaaaaaaaaaaaaacaacagaaacccacacaccaaaccaacacacaatacagaaaacaacaccacagagaggcgggggcggcgcgccatatgaaaaactccccccggaggggagcgcgccacatttttccgcgcaccccgcacttttcgtggagcaacccgggggggcccccctaaaaagggaggcgtcacataaacaccgaccacaccgccgaccgcgcccgaaaaaacagcgcgccgcgtgacgcggcaaacaacgcgcacagcgggaccaaccccgaggggaagaagagcccccccaacacgcgggggggggcgcacaaactggggcccacaact

SEQ ID NO: 260956 - DNA, 548 bp, Homo sapiens
ttgacgttggtcttgtcggcaggagacagctcgtgccgaattcggcacgagcggcacgaggggcacgagctgcatcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260957 - DNA, 515 bp, Homo sapiens
gcaaaaaaaaaaaaaaaaaaaaaaaaaactcgtgccgaattcggcacgagctcgtgccgaattcggcacgagcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260958 - DNA, 601 bp, Homo sapiens
gttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaatctcgtgccgaattcggcacgagatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260959 - DNA, 501 bp, Homo sapiens
  misc_feature (472)..(472): n is a, c, g, or t
  misc_feature (476)..(476): n is a, c, g, or t
  misc_feature (483)..(483): n is a, c, g, or t
  misc_feature (485)..(485): n is a, c, g, or t
  misc_feature (497)..(497): n is a, c, g, or t
ggcggccgctcgcgatctagaactagcatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaanaaaaacnanaaaaaacaaaanacaa

SEQ ID NO: 260960 - DNA, 707 bp, Homo sapiens
  misc_feature (558)..(558): n is a, c, g, or t
gcaaaaaaaaaaaaaaaaaaaaaaaaaactcgtgccgaattcggcacgagctcgtgccgaattcggcacgagcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaaaacacaagaagaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260961 - DNA, 833 bp, Homo sapiens
  misc_feature (684)..(684): n is a, c, g, or t
gcacgagcttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaactcgtgccgaattcggcacgagcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaaaacacaagaagaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260962 - DNA, 863 bp, Homo sapiens
  misc_feature (714)..(714): n is a, c, g, or t
ttgacgttggtcttgtcggcaggagacagctcgtgccgaattcggcacgagcggcacgaggggcacgagctgcatcagaagaggccatcaagcaggtctttgcgttccaagggcctttgcgtcaggtgggctcagggttccagggtggctggaccccaggccccagctctgcagcagggaggacgtggctgggctcgtgaagcatgtgggggtgagcccaggggccccaaggcagggcacctggccttcagcctgcctcagccctgcctgtcacccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaaaacacaagaagaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260963 - DNA, 653 bp, Homo sapiens
ttgacgttggtcttgtcggcaggagacagctcgtgccgaattcggcacgagcggcacgaggggcacgagctgcatcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260964 - DNA, 710 bp, Homo sapiens
  misc_feature (561)..(561): n is a, c, g, or t
ttgacgttggtcttgtcggcaggagacagctcgtgccgaattcggcacgagcggcacgaggggcacgagctgcatcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaaaacacaagaagaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260965 - DNA, 677 bp, Homo sapiens
  misc_feature (528)..(528): n is a, c, g, or t
gcaaaaaaaaaaaaaaaaaaaaaaaaaactcgtgccgaattcggcacgagctcgtgccgaattcggcacgagcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaanaaaaacacaagaagaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260966 - DNA, 701 bp, Homo sapiens
ttgacgttggtcttgtcggcaggagacagctcgtgccgaattcggcacgagcggcacgaggggcacgagctgcatcagaagaggccatcaagcaggtctttgcgttccaagggcctttgcgtcaggtgggctcagggttccagggtggctggaccccaggccccagctctgcagcagggaggacgtggctgggctcgtgaagcatgtgggggtgagcccaggggccccaaggcagggcacctggccttcagcctgcctcagccctgcctgtcacccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260967 - DNA, 680 bp, Homo sapiens
gcaaaaaaaaaaaaaaaaaaaaaaaaaactcgtgccgaattcggcacgagctcgtgccgaattcggcacgagcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaaaaaaaaaaaaaaaaaggggggagcgcacaaaaagatccccccgggaggggcacccagtgaggaggaccacagtagggggaacaagggggggcccaaaagggggggccgataaggggcgggggc

SEQ ID NO: 260968 - DNA, 617 bp, Homo sapiens
  misc_feature (588)..(588): n is a, c, g, or t
  misc_feature (592)..(592): n is a, c, g, or t
  misc_feature (599)..(599): n is a, c, g, or t
  misc_feature (601)..(601): n is a, c, g, or t
  misc_feature (613)..(613): n is a, c, g, or t
ttgacgttggtcttgtcggcaggagacagctcgtgccgaattcggcacgagcggcacgaggggcacgagctgcatcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaaaaaaaaaaaaaaaaaaaaaaaaaaaaaaaaaaaanaaanaaaaacnanaaaaaacaaaanacaa

SEQ ID NO: 260969 - DNA, 997 bp, Homo sapiens
gcaaaaaaaaaaaaaaaaaaaaaaaaaactcgtgccgaattcggcacgagctcgtgccgaattcggcacgagcagaagaggccatcaagcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcaaaaataaacatacacaatactaacactacaccaaaccaacataaacacaaaacacacaaaaataaaaaacaacaatacacaacaatacaaacaacacaaaacacaaacaaacacaagcctgcggcccgctatctcttatctatagctatcaaccaccaagtggagcggtcacagaatcaatacccgtcgacgaccgcgagcgaggcagtactaatactgatgacaagcggcaggaggggggagcgccgcccagactggcgagcgtgggcattgacacaccacggacagagggtgggcagggacaagagaaggtctgcccaactccgaggctgagccgcagcatgagccgaaaccaactagcagccgcgacagcgggcgacccttctaggatgagagagaggagacgaggacccagcacatagcgcaggccgaaggggcggggggcaatccaacgatggggagagcaaaggagagaagactg

SEQ ID NO: 260970 - DNA, 546 bp, Homo sapiens
gcacgagcttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaactcgtgccgaattcggcacgagcagaagaggccatcaagcaggtctttgcgttccaagggcctttgcgtcagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggctggagaactactgcaactagacgcagcccgcaggcagccccacacccgccgcctcctgcaccgagagagatggaataaagcccttgaaccagc

SEQ ID NO: 260971 - DNA, 320 bp, Homo sapiens
ctggcgggcaggcgggcactgtgtctccctgactgtgtcctcctgtgtccctctgcctcgccgctgttccggaacctgctctgcgcggcacgtcctggcagtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagc

SEQ ID NO: 260972 - DNA, 526 bp, Homo sapiens
actcttactttggtaagataagtgtgtgtacacctatctatctcattttctgagccatatgcttcttgggggcaggaatcatgttagttatctctgtacccttggcacagtaagtacttaaatatgttagtttcctatcccccatagtactggtacaagaacctaaacccagtggtattcaataaatgctggataaggatgataacattaataacagccattcagcacaactccactaagttgtcagaccagtttaggatattggcatgaaaaatgctttttctcctggcccagacatttactcttaagatttgcctcctcctcaatagactccaggaaatagggttagttttaagttctagaaactctaatcattcctgttttctccaaactaagggcctgaaggaagactgcagatacctcatgaatattgatgagcctctgcggtcacatgaatattaacaacaccctgtggctttcgggaacagcagcccagctagaaggtctaatattaaccttggctagg

SEQ ID NO: 260973 - DNA, 526 bp, Homo sapiens
gttgcattcatccaccttaaatgaagcagagagttttgtcatggtatattaatactcttaagcaacgtaaaacatcaccccaaagagaaaaatcgtcttctgaatcatgtgtttggctgtcagggtgggcctgcagtcactgaatacaggccaggattccatctcttgcattggctgtagaatcagagacttgggtccatgataagccatttgttaaagctcattgagatcctgaaaaccaagcccatctctgctctgccttacagagttcatggcacatgagaagagaaggaaggatctgctcctgtgacctgggccaagatttctagaacccagcttaaaatttataagataagtagaacttgagtcatggtataaagttcctacagggcagttttctaatgagattttttcacttctaacaaagatgttctttagcctctccttgagctccaaatcttatttaagagagagagagagctagagcaagctagagaatgaataaaatacaaagcaaaacagacaa

SEQ ID NO: 260974 - DNA, 133 bp, Homo sapiens
gggaaatcccacgtaaggaaagcacgggtagtagagaaacttgggaacaaataacacctagaaactgaggcagcaagatgcaccttagtctaggaagccttcttgaaagaggggagtctctggtaagaattag

SEQ ID NO: 260975 - DNA, 647 bp, Homo sapiens
ctggtgaccccactttctgagccccctggttcaatctctctcatggggtggtgaggggtgctgccctctacaaggagggaagtggggacttgggggttgaatgactccttctgtagactttgacttcatcttcctgtttgcagtccttacctcccctctgtcccttgctgacttgtccctttaatttttttatttatttttatttatttatttatttttgagacagaatcccactctgtcacccaggctggagcgcagtggcccgatcttggctcacttcaacctccacctcccagattcaagcgattctcctgcctcagcctcctgagtagctgggattacaggcgcctgccaccatgcctggctaatttttgtatttttagtagcttcggggtttcaccacgttggccaggctggtctcaaactcctgacctcaggtgatccgcccgcctcagcctcccaaagtgctgggattacaggcatgtgcccccatacctggccttgtccctttaattctgagtcttgtcacagcaagttcccttgcttctgtctccccttctgcagattctcaaaaaaaaactaaacatcacaaaaaaaacatttttgggcgcttggccccgcgaaaagttctgaaaaccactttttgg

SEQ ID NO: 260976 - DNA, 308 bp, Homo sapiens
ctggtgaccccactttctgagccccctggttcaatctctctcatggggtggtgaggggtgctgccctctacaaggagggaagtggggacttgggggttgaatgactccttctgtagactttgacttcatcttcctgtttgcagtccttacctcccctctgtcccttgctgacttgtccctttaatttttttatttatttttatttatttatttatttttgagacagaatcccactctgtcacccagccaagatcgcaccattgcactccagcctgggcaacaagagcgaaactctgtctcaaaaaaaa

SEQ ID NO: 260977 - DNA, 305 bp, Homo sapiens
ttcccaaggaggtgaggttgcctgtggccccctcccagggcacagtcccacccctccagtagtgcactctgtcctccctggtaggtacaggcttttccccaccaccatggtgcagccatgcctgcccccaacaccactggtgcagctccatcctccacgcagtggtgcagccccatcccagcgcccattcgagctgctgtcccattgcagggggcattgtgacagctgaggacctgaacaactactgtgctgagctgatcgagcacccgctgaacatcagcctgggagacgcggtgctgtacatg

SEQ ID NO: 260978 - DNA, 494 bp, Homo sapiens
cctgcaaaggacatgatctttttcttttttatggctgcagggtctggtatcttttgcttaacataattatctgtgattcatccgtattgctgcatgcaaatagtttgttttttaatgccaagaattttccaaggtatgactttacagtatttgttcataacattatttatgaacatttggattgtcctcagttttgggctattagacgtaaagctgaccttaatttcatggcataggtaatgattcagaattgtattgggttgcagtgtttatcacaatactgtaaattagaaatttaaattcctgttaggaaggagaaaagccagcagtaattgtaattacagataagcagtatctgtaatttttttgaagacatgccatagaaagaataattcacatagaaataatgttttgcaaggtttcatgtatagtgtacgggccaggtagatgtagacaattccttggacttttgttggctttctgggaaaaaaaaa

SEQ ID NO: 260979 - DNA, 508 bp, Homo sapiens
gtggagaagctcagaactcctcctaggaagaaaatggatccaccctttccctggagaggagataaaggagcctgttggtggatcaaatgaggctttagctggggtcgcccaggccctattcaacagaggacacagctgtgtgagtgagaacaaagacctgctacttctcaggcaattttagacacactgtgttaatacatgacacaactgggggcactcttgggaaaggagtttgaacaatatcctcaaagtggaaactgtgtttcgtttaggtctaaaaccactgacaaattttgtatttcatgttagacatttgatgtttttggatgttttatgacagtcacgcatttctttgtaatcagaaaatattagggtataatcattcatatgtgtttgtgtattgaaaagtacagcaaaatgaagatatatgtagatcctccccctacaagtcaaaaagactgtagctcttttctctcccaccctgagtcaataaaggactgatatctac

SEQ ID NO: 260980 - DNA, 379 bp, Homo sapiens
atcaaaaaaatacttgtaggatattcttttttttttgagacggagtctcgctccagcctggtcaacaagagcataactccgtctcaaaaaaaaacaaaacaaaacaaaaaaaaaacaaatttagcaaggaagcatactagagtaatatataacgtaaagaatcctcttgttagtgtaactactcccaacctaatctagtccgagagtcccaagttatttatgtggtaatttcataagatagggaaaatgtgtatttacattttaaagttgtattcaaatagcaaatatttattgatcacctactttgcaagtcagagcatcatctctgtcaaatgctattctgtatctggatatttccaagcttcccttagcccaatca

SEQ ID NO: 260981 - DNA, 323 bp, Homo sapiens
ctagtaactagcccagttgttatcagggggagatacaaggtagaagaattctacctggaatttcaatcctaactaaagagtgtgaaaatttgagggaattgttctagtgatctttagagaatgcagtatttttgatataccagaagaaagtacactctgtgtattcaaaatgtgtctttatttgtaattgaagaatactctgctgtattataacttctcagagagtgtgcagaatctttagctaggtaggaggatatagttataaaagaaaaacaggaagtattagaatctgatacggtggaagggaacctaaacctgaagta

SEQ ID NO: 260982 - DNA, 141 bp, Homo sapiens
ggagtttaaattggtattgcattggagggatgattctagcagtaccaatcattatttaaatgtttgagttttctgaccaagcttctgagattcttaacagaaaaagccatgtacaaagatgtttatgacagcattatttac

SEQ ID NO: 260983 - DNA, 390 bp, Homo sapiens
aaaccagtagtaagttcaaaacagccaccctgcagatttccttgctcacctcttttgtcattctgtaacttttcctgtgccctgaaatagaacgcacacccgtactactttacttcatcgagattcttactctgttcctctgtggctactctcccatcttaaaaatgatctgagtagtcctttacgcgtcgttcctgccccctatcctgcacatctcattttccggtgtgacagcaagttcagcatctccaggactttgctctgctctcactccttaaacccttaaaagaaaaagctaagcctaagctatttgcctttaagtcataaagacaccagaagtatttaaagtacagatctagaagaagaagaacgcctagatcaaactgaccc

SEQ ID NO: 260984 - DNA, 556 bp, Homo sapiens
tgccgaggcaaacctcctcacaccagccaagtgcacagatggtgggaggaagaggcagatctgcaggctggaaagttgcagctgcagccatggcagccaccacctccctgccccacccaagcggccccactgcatctgctttcactttatgtcagaacctcctgctcccaggccagctctgcacagacagtgagatgacttccaatgcaacacatccggggacttcccattattgaaaaacagatcctcccatgtcctggcctttgggatcctggctggctggcttcatgtatgggcacagggtgggaccaagtaagacctgaccagtaaatcttggatacttaatggccctcaaaccttccagtaagaagaatgactcctttctgaactgctgtccggcccatgcctggtcactggacgcttggaacccatttattctggttttgtgaagaatttcctagtggatcatggccaacagttgtcaacaacaacaacaacaacaacaacaaaggcatgagagacctgcatgcaaatcctgactcttcccattcctggc

SEQ ID NO: 260985 - DNA, 479 bp, Homo sapiens
gtcagttacagattgatctccttgttctgctccttcccctcttctcactactgcatttaactagtcttaaagaaaaaatttcttctcccccagtaagtgaaagataggaaaatatttgaaaaaaagtgaaataactttcaaatcctatgtatttggagagcacggaaaaatgtcctgcaattccagttgaatgaaatgttgcatataggccgatctacccagacagaaagtcgattaatggttgcctagggctgggcgcagggaaagaggtaatgggaagtgactgctaatgggtatgggatttctttttgggatgatgaaatgttctaaaattagactggggtgatgggtgcacaactctgagtatattaaaaactattgaattgtacacttcaaatgggtatggtatttgaattttgtctcgataaggcagctaaacatttttttatgctgatactacctcagtagaaaatgggcta

SEQ ID NO: 260986 - DNA, 535 bp, Homo sapiens
aattagctcagagaaatgccaagtgtgataaaaaatgaaatagattgacattccttccttccccagtgattcattggccagggtgaggaggtagaagaagaaataccaggaaccacatatccaaacaattttgccctcttctgttttgtagaaagtatttgaggtgacgctcacaattcaaggagatatctcagggtgtaagatttataccaatttaaactacaagtccagagaaaaggaagtttgggaaattccctttaactgattttgggagaaaaaagacaggattgagaatcagggaaacatttctgattttatgtgtactgggacattcttgctgatgtaagataacatattttgcagtagatctttaatttatgcctctcactggagccccctcttcattcccatgtagctgaaccccactccttcctcttgtaagttgttcttttgcattattttacaaaagtaagccatgcttatttgaaaagatttatgcaatataatataggaaataaaactgaagataaaactg

SEQ ID NO: 260987 - DNA, 491 bp, Homo sapiens
gttgtggaatggggaatggctacattctttaagtggcacccagttcactgtaattttaaatgattaaatgatcataataacaagttaagtgtatgtgtttaagagtataaaaaagttaagttgtggataatctgcattcagtgttattaaaggtagaagacagggttgtgaaattttaaaaagcaggataaaagtattcaagagaaatgaagtgtaataaggagtaatctaaaatgattacagataaatcagtgcttaaagattgaaaatcatctcaatgagatgactcaagaatcagaaaattactttggatgttggtagagttggcaaaatgacatatctatatctgcttggtcaggtttcactatctaatgtctattagtaaattaattatttttacaactagaaattcaactaagtatttaaaagctaaggatataggaagaattacagactgatagagaagatgggagaaaagaaagaacagaata

SEQ ID NO: 260988 - DNA, 420 bp, Homo sapiens
aacaaagtgtgctagttattttgttgcctttcagatcaaatccacagactccttctaccctgccctttattccaagaggctgccctctgcagactatgatacccaggctccttgccttctggctcctggttaggcttgggtaatcagaagcatgagaaatgaatcagaagttgggaggagagaggggtggagaaatgttgtcactctacaccctcccttctgggctgggctgtggcagtggctgtgctcgtctatatctggtcacagctctgcctggtggcccatacccatggctacacctctcactccgttcccacaacagctccttcatcattcaccttcagccctagggggttggaactagtgtccccctgttcccagccctacatgcttctctatcctttgtctgtttcccttcgt

SEQ ID NO: 260989 - DNA, 552 bp, Homo sapiens
gactctggcagtggtgagtagcaattcttgctaggacctgcatttttcttcctcttaatttgctgttttcccacccttttctattcttgctacattttcatgcttctcactcctgctccaaaatgccacttcccacctaccagtactgttcttaaacatctcctgtgtctcaggaagtcactatttaagaacagacttatttaccctttgagccttagtcccttcatctgtaatatgggaataatgacaataaaaactctatatggggccaggtgcagtggctcaagcatgtaatcccagcactttgggaggccaagacaggtggatcacttgaggtcaggagttcaggaccagcctggccaatgtggtgaaaacctgtctctactaaaaatacaaaaattagctgggcgtggtggtgcacacctgtaatctcagctactcgagacgctgaggcaggagaatcgcttgaacccaggaggcagaggttgtagtgagctgagatcgtgccactgcaccccagcttgggcaacagagcaaaactctgtctttaaa

SEQ ID NO: 260990 - DNA, 656 bp, Homo sapiens
catctatgttggtacatgtttaaatagtttgtccttttcagtactaagtagtattccattgttaaacattttatttatacattcacctgctgatggacatttgtgttgtttccagtttgggttactttaaataaagtgaaagaacacttgtgtacaactctttttgtggacacatgctttcatttctcttggataaacacctaagagtagaattgctgaatcttatggtaaatctatgtttaactttataagaaactgccaaaactgttttccaaagtggttgtacaattttatattcccataagcggtgtatgcaggaaaatctcagtggtttcatatcctcatcaacagttagtatttggggtccttttaattttagccactctaatgttctaacggatgtgtagtgatatcacattgtggttgtaattttcatttccctaatgatgaatgatattgagcatctagtcatggatatattggctatctgtgtatcttctttggtaaagtttgttcaaatgtgtccattttattgactttataattggttctatcagtgagttgaaagacttctttatatattctagatatcagtccttataatataaaatagtatacacacacacacacacacacacatatatattttatctgtc

SEQ ID NO: 260991 - DNA, 642 bp, Homo sapiens
ttggtacttgaacaagcttcttcttagaacccttggcatttgaactagacattgaagggatttgagatgaaatacgtcaggaaaaaaggctgaatatttgaggcagaggaagtatttttggcaattttgtgaaatattcgttagaatatttgtgttgagtaggaaagttaaattaagaggcctctaattggcattctcagcacccaggtgaatagtgctgttgacagtggtatggagatagtattgaaatgtgatttaccctgactactatgttggtatcagtggactccaggaggtaaagttagagaaaaagggtacagcctagtaaacagcctttattgagaatttgctatttaagcctcacaacaaccttcttaggtaatttatagatataggaactaagtaagccacagagatattgagtaactcagcaagaggcagagccaggatcccaggcagtgtgtgtccacagccctccctccacaatgggtgctgccatgaatctagaatctttcatcaaggaaaatttttcagtggtgccatcaaacttgccatttcaaaacttgccatttctgtagtgaacattataatcccacagacacacgtggtacacacacacctttactatagatcatcaagaag

SEQ ID NO: 260992 - DNA, 431 bp, Homo sapiens
agaaaaactttcaagtgctcatgattcctttaaataaattaaaatcagcatctgttcacatgcaagagctttagtcatcttccactttaaaaacaggtttattacataaaagcagactaacccagatgatcctaaaaatttccagcatagttctccaacactacgaatttcaagtagtaacaataccagcttagacttaaataaaccagatttctctctaaagcatctccatccaccataaaaaagttattttgagcaacaaagattttttaaatccagtaaattctagacatgccatgttacgcagctaccactttgagctcctgctttgatgccataccacctgccattagtcaatttgatgataaccaaatttacaaagaaatctgaaacaatgaagcaatctagtgtgagagggtacaccactgtgc

SEQ ID NO: 260993 - DNA, 365 bp, Homo sapiens
caccccgtccgggagggaggtggggggggtcagccccccgcccggccagccgccccgtccgggagcttactctgagggaggtctgaatgccatattgtgagcggccctgctgaaagacccatgtggcaaggatctgagatcattggccaacaggctgcaaagagtcctaccaacagccaggctggtgttcttggaagtggatcttctcctactctcctacttgagatgactgcagccccagctaacacttcgattgcagccttgttaagatatcacgggccagacacacccagctaagttatgcctgagttactagcccacagaaatgataagataataaatatttgctgttttaagctgctaag

SEQ ID NO: 260994 - DNA, 325 bp, Homo sapiens
cctctcgctctctttcattctctagcttactctgagggaggtctgaatgccatattgtgagcggccctgctgaaagacccatgtggcaaggatctgagatcattggccaacaggctgcaaagagtcctaccaacagccaggctggtgttcttggaagtggatcttctcctactctcctacttgagatgactgcagccccagctaacacttcgattgcagccttgttaagatatcacgggccagacacacccagctaagttatgcctgagttactagcccacagaaatgataagataataaatatttgctgttttaagctgctaag

SEQ ID NO: 260995 - DNA, 1136 bp, Homo sapiens
tgcgctgccgcaacgaatagggtttctggctgcgtaggagggacgggggcgcggagctctgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggagaaatttggacacagagacagacacgcacagaaggaagatgatgtaaagacacagagtaccacgtgaggctggaggactggagtgatgtatttacaacccaaggaacgtctaaggttatcagcatactgtcagaagcaaggaagaggcaaggaaggatcccctacaagtttgaaaagtgtcatggccctgctgacacatttattttggacttttagccagaactgtgagaaaataaattgctgtattttcaagtc

SEQ ID NO: 260996 - DNA, 462 bp, Homo sapiens
ttaggagtttgattggggttgcattgaacttaatagaacaatttggggagaattgacatccaaacagcaacagagtccttgtatccatgaaaatagtatatttctctgtttgtgtaggtcaccttcaatttttttcagtaatgaagttaaaataaggtcattagaatgggccctaatccattatgactggtttccttataaaaaggagaaatttggacacagagacagacacgcacagaaggaagatgatgtaaagacacagagtaccacgtgaggctggaggactggagtgatgtatttacaacccaaggaacgtctaaggttatcagcatactgtcagaagcaaggaagaggcaaggaaggatcccctacaagtttgaaaagtgtcatggccctgctgacacatttattttggacttttagccagaactgtgagaaaataaattgctgtattttcaagtc

SEQ ID NO: 260997 - DNA, 431 bp, Homo sapiens
gtggctcacgcctgtaatcccagcactttgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcgtggtggtgcatgcctgtaatcccagctactcatgaggctgaggtgggagaatcgcttgaacccaggaggtggaggttgcggtgagccggatcgtgccaatgcactccagtctgggcaacaagagcgaaactccatctca

SEQ ID NO: 260998 - DNA, 2009 bp, Homo sapiens
  misc_feature (2003)..(2003): n is a, c, g, or t
  misc_feature (2005)..(2009): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 260999 - DNA, 1864 bp, Homo sapiens
  misc_feature (1858)..(1858): n is a, c, g, or t
  misc_feature (1860)..(1864): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261000 - DNA, 1852 bp, Homo sapiens
  misc_feature (1846)..(1846): n is a, c, g, or t
  misc_feature (1848)..(1852): n is a, c, g, or t
ggccgtgggtgtacgcggcgcagcgcggcagtcctgatggcccggcatgggttaccgctgctgcccctgctgtcgctcctggtcggcgcgtggctcaagctagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261001 - DNA, 1813 bp, Homo sapiens
  misc_feature (1807)..(1807): n is a, c, g, or t
  misc_feature (1809)..(1813): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261002 - DNA, 558 bp, Homo sapiens
  misc_feature (552)..(552): n is a, c, g, or t
  misc_feature (554)..(558): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctgtagcctgctcccacactgtcactggatgtcatggggccaataaaatctcctgcaattgtgtatctcaaanannnnn

SEQ ID NO: 261003 - DNA, 1108 bp, Homo sapiens
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaaggtgagagaacctggtcttgcagctgaggggataggagtgggacctggacagggaatcctgtgggacatgggttacctgggacacagtggagaatcagacctgagaggtggaggcagaggggaagcaagagaaactcaccatggagcgtcagatcagtacacactcccaggaagttaaccctgaacccaagttagctcttgcctaaatgtccaagtcaggataggatccaaggaacttgaatcaagagatcaccttggtgggccgagcgtggtgtctcatgcctataatctcagcactttgagaggctgaggtgagtggatcacctgaggtcaggagttcaagaccaacatggcgaaaccccgtctatactaaaaatacaaaaattagacaggcatggtggcacgctcctgtaatctgagctgctcgggaggctgaggcatgagagtcgcttgaacctggaaggcagaggttgcagtgagccgagatggcgccactgcactccagcctgggtgacagagtgagactgtgtctcaaaagaaaaaaaaaaagagagatcaccttggcaagccaacctctaataagggtggtaagatgggctctataaagattccagtctcagctgggcgcagcagctcacgcctgtaaccccagcactttgggaggccgaggtgggacaattgcttgagcccaagaattcaagaccagcctgggcaacatagatcccatatctaca

SEQ ID NO: 261004 - DNA, 263 bp, Homo sapiens
  misc_feature (230)..(231): n is a, c, g, or t
agcactggcctctactgtgcttgcgggggaaaacgactgagagtgggagtttgccgcccgagggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgacgggcttctatgcacnnctcctggggcaacagtgtaggcgagtggcaca

SEQ ID NO: 261005 - DNA, 349 bp, Homo sapiens
tagcctgagtgacagagcaagattttgtttctttaagaaaaaaaaaaaggagaaaaaaaaatcagccacaacctcacttagaccacctgagtctcagcctgacgtctctgttctgcgtcctgtggctcagtcggggaggtgcctttgctgggccggagcatcttgcagtcggtctccttctttttcgcagtctgtactctggtggcttccagtggaaaaggcattttggaggcaggtaagggctgattccgctacctcattttctacccctgcttgactcaggtggtgtgatcgggataaaaatgacaaaaataggggtacttgtgccgttgcgaacatatggtatgta

SEQ ID NO: 261006 - DNA, 284 bp, Homo sapiens
ccccccggaggacgcgcatgtcctgctcagcagcctggtacggtgatgctgtccactcccacacgttccccaggaggtcatagagcccgtagttggtgcggtttggctggaaccaggaaaattctgccttgaggaaacaatgtcagcttcctgaatcatccagggagaaagggggagagaatagattttaaaatgcttaaaaaatggcctttcagagtgctctgttccaattgtttgtgtgtttgcaatcctgtgtcaataatacttggcctctaacagaaaca

SEQ ID NO: 261007 - DNA, 235 bp, Homo sapiens
tagcctgagtgacagagcaagattttgtttctttaagaaaaaaaaaaaggagaaaaaaaaatcagccacaacctcacttagaccacctgagtctcagcctgacgtctctgttctgcgtcctgtggctcagtcggggagatcctttgagcctaggagttcaaagctgcggcgagctatgatcgcaccactgctgtctggcctgagtgacagaacaagaccctgtctcaaaagaaaa

SEQ ID NO: 261008 - DNA, 1227 bp, Homo sapiens
  misc_feature (1221)..(1221): n is a, c, g, or t
  misc_feature (1223)..(1227): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctccatatgcctccaaaaacatgtccctggagagtagcctgctcccacactgtcactggatgtcatggggccaataaaatctcctgcaattgtgtatctcaaanannnnn

SEQ ID NO: 261009 - DNA, 788 bp, Homo sapiens
  misc_feature (782)..(782): n is a, c, g, or t
  misc_feature (784)..(788): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgtagcctgctcccacactgtcactggatgtcatggggccaataaaatctcctgcaattgtgtatctcaaanannnnn

SEQ ID NO: 261010 - DNA, 1964 bp, Homo sapiens
  misc_feature (1958)..(1958): n is a, c, g, or t
  misc_feature (1960)..(1964): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261011 - DNA, 1784 bp, Homo sapiens
  misc_feature (1778)..(1778): n is a, c, g, or t
  misc_feature (1780)..(1784): n is a, c, g, or t
agatcccccatacagagtactaacaaagatctcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261012 - DNA, 1731 bp, Homo sapiens
  misc_feature (1725)..(1725): n is a, c, g, or t
  misc_feature (1727)..(1731): n is a, c, g, or t
ggtcccggtcagacgggtgcatagcgattagctcagttgaggatcttgctactgcaggatggagcgtgacgagaacaaagccagccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261013 - DNA, 1858 bp, Homo sapiens
  misc_feature (1852)..(1852): n is a, c, g, or t
  misc_feature (1854)..(1858): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261014 - DNA, 1631 bp, Homo sapiens
  misc_feature (1625)..(1625): n is a, c, g, or t
  misc_feature (1627)..(1631): n is a, c, g, or t
ggtggtgacccgggcccggtgattggcagagccatcagctgtgtcgatccaggatgccccccggaggacgcgcatgtcctgctcagcagcctggtacggtgatggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261015 - DNA, 1698 bp, Homo sapiens
  misc_feature (1692)..(1692): n is a, c, g, or t
  misc_feature (1694)..(1698): n is a, c, g, or t
ggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgaagggcctgtgcgggaggcgacagtgaaaccctttgccatcgacatatttcctgtcaccaacaaagatttcaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261016 - DNA, 2028 bp, Homo sapiens
  misc_feature (2022)..(2022): n is a, c, g, or t
  misc_feature (2024)..(2028): n is a, c, g, or t
tctcgatctcctgacctcctgatccgtctgccttggcctcccaaagtgctgggattacaggcgtgagccaccatgccctgcataatttttgtatttttagtagagacaggatttcactgtgttggccaggctggtctcgaactcctgacctcgtgatccatctgcctcggtctcccaaagtgctgggattacaagtgtgagccaccgcgaccagccagtgatcgaagtttttaatatgacctgtgaggttgcctctggctcattcatttatgcaatctaagtccaatttcaagtttctcgatttctgtacttttctcaacatgaactgataacagatgctttataaactggctcaggtcccagaaccatgcttaggattacattgccctggagcacatgaggaggccagggccctctaatgcagttcagcgagtggagaggatgggcatggcaaataaaagcaggtcattcactcttttttctcatcaccctctaacttccttttgattccctcactctttctgtgttcttttttccttccctaattcttcacctccccctcctctgctgcctccttgctctcctcgcaggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctcaaanannnnn

SEQ ID NO: 261017 - DNA, 460 bp, Homo sapiens
aggcccagcctcctctctacccctcgtacatccaggaacactgagtttcaaagaaggataggggaatatcagggaaagcgctcagcaggcctgtttcacctgcccgaatcctgtttcctgttacccatccatttctcccttcagcctcctgtagtctcttttttctgactccgaccactggtcactcacccggctctcttccagctctcttgctccatctagtggtaaaagctgaacgcgggcgccctaaacctagcctgcctccgacttaatgcgctcccggaagcctgtctcacttaatcctggctgtcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttg

SEQ ID NO: 261018 - DNA, 426 bp, Homo sapiens
ggccagtcctccgcctcgctccgtcagtttccccctgctgaactattgggtgcggggcgggtggtggcgcagcctgcgcatgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggtcagtgaaccggccgtccatcctgggggcgctgggaaggggatggggcgctccgccctgacgggagagagccttaggcccttctgccggcttccgggatgcggctgcagcggcaggctggggaggtagctctcggtgcgcgtggcgcctcaccgccttatacttttcaacttcttgttgtggaatctttc

SEQ ID NO: 261019 - DNA, 387 bp, Homo sapiens
tcaccagctgaaccagctgaactatgtctttatagggattttgtcagggagaaaaagtatcggacagaagctgagatgtttggatggagctttgtctttgaggactttgtctctgatgagctgagaaacaaagccacccagccaatgaaggtgagagaacctggtcttgcagctgaggggataggagtgggacctggacagggaatcctgtgggacatgggttacctgggacacagtggagaatcagacctgagaggtggaggcagaggggaagcaagagaaactcaccatggagcgtcagatcagtacacactcccaggaagttaaccctgaacccaagttagctcttgcctaaatgtccaagtcaggataggatccaaggaactt

SEQ ID NO: 261020 - DNA, 499 bp, Homo sapiens
tctccagcctgggtgacagattgagaccctgactctaaaacaaaaacaaacaaacaaaaatttaaaattcctgaaaactttagctgatttctctgtgctctgatctatggtgaattcacactcctactgcagctactgctgcaggtttgagaagagccataggtcctttttcacttatgaagggcttgacactttctggaatttatttcctttaggtttctttgcatcattagctttctgaaagagagcgattttgtaacttatgtagcttgttctgcttgttagagtgggagcaatggtctcttgcaactttctacatctcaattgaaatacataaattctgggtaaagcttttaaaaatattcacttaagatgcatggaggaaaaatcagagctaaactgaaggagattgagatacaaaaaccattcaaaagatcaacaaacccagtagttgggtttttgaaaaaattagtaggatagataggctgctgggtacact

SEQ ID NO: 261021 - DNA, 300 bp, Homo sapiens
aaaaaataaaaaaataaaaagcagctctgggaaaaggcagtctccctggatttaaacctccagctctgtggatttgcagtgggaggaagcttgttgcctcagatcagcccccgacttacttgcatcagctttttatcctgataggccttgtgttttgccctgcttgtttcttctctggaggcaattgtatcatatccttgtttttttccaatccttagaccttgaaaaaatgttttccttagtgtaatggtcagaaccttcaaattaatgttgaataaagtgataatagcaagaaaaaaa

SEQ ID NO: 261022 - DNA, 327 bp, Homo sapiens
accctgtctcagaaaaaaaaaaaaaagtactttgtaatctgtaaggtttatttcaacacacacaaaaaaagtgtatatgctccacgatgcctgtgaatatacacacacaccacatcatataccaagcctggctgtgtcttctcacaaatgcactgctaggcaccacccccagttctagaatcacaccagccagttcaccctccagatggttcaccctcaacttcataaaagttccctacctaatctactgacaggctcatccccgacctaattttaaagatttcctaggagctgcagtgggaatcctggacctcagcctggacaaag

SEQ ID NO: 261023 - DNA, 587 bp, Homo sapiens
ggttttactcatgttgctaagtataactccggtgcatttgttttcactgctgtaaagttgtctgtgtactgcgatgtatttatccatgttgctggatagttgggtcatttccaggtttttgctaggagaaggagcagcgccactctgaacattcttgtgtgtatctccttgtacacatgaaaaagagtttctctagaatacgtacttaggaatgactttgctggatcatagggtgatgttaaagtgttttccaggttatcagtttgcactgctgtgagcagtatctgagagttctcgttgcttgtgccaatcttggatattggtcatacttaaattttacttaatttgatgaatttgaaattgtagttttaatttgtattttcttggttactaatgaagttgagcatcttttcacgtggattggccattcaaatttttgtgcgtgttaaagtgttcaggctgggcacagtggcttatgcctataatcccagcactttgggaggccaaggcgggaggattgctggagcccaggagtttgagatcagcctggcagcgtagcacaaccctgtctctaccaaaaaaaaaaa

SEQ ID NO: 261024 - DNA, 591 bp, Homo sapiens
ccttgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaa

SEQ ID NO: 261025 - DNA, 519 bp, Homo sapiens
ggacatacattcccaggaacaatggaatgctttagaaggaggagcatagattttgatgggcagttaactgcatctgctatgtgctctttctgcccaaggattctcatacaagctgtatcacctgcttgaaatgctggtctcccactccttatctggctagctcctatttatcattcaggtcttatcttaaaacttattttttctaggtaggtttagaccccatagaaacttgcaaatctctttggtagctttgcatgtgtgtggaagtgatggtgtcacttctgggtcaaagtgtggctcccccatctctctgctgctggctggatgacgctctccaaagttctaagggatggcagagccataagagagggggagcctgggatcctgaatcccccccaagaaagaaagatacccatggaccaggtgcatttataggataattaattttatgtgttaacttgactgggttaaaggatacccagatagctagtaaaaacattatttctgggcatgtggtga

SEQ ID NO: 261026 - DNA, 752 bp, Homo sapiens
gaaggacggcggtgaagggaaatcctcccagtgggaagaagataagagtaatgtgcctggttgttcattttgcctggttagaagtatagatctatactttttcatgagcagtggctaatgacttggctggatggtcagtacttgagaggaacataattaggaagttggtgacaaagaggtctaggaaacaggtatgtggatggacttcagcccagaatgtgaagataattatttcccacatgagtgcttatcaaagggcgacctccacagaggattttaatgaggtggatagaataacccatttagtggatgtcagtcagcctctttacttagccaaatggactcatgaataaagggctagggatggaggttacacatggggtcaacgtggactttcactcgccagggacaatctggctacagctcctgatatggcaacactcctgggggctcagccagctatctggttgtaggttggatatggatttgctgttcctgcccacaatgcatctgccaaaacaactatccttgggtttaattatttcacacactgttgcctctgacttaggaactcactccacagcaaatgaagtgtggcagtaggtccttgctcatggaattagctggtcttaccatgttcccaattatgctgaagcagttggctttacacataggtgtaatcaatctcttttctcttaatttcgccaactcaatatataaaaggcctgttgaaaatggtgtacatcaaaata

SEQ ID NO: 261027 - DNA, 461 bp, Homo sapiens
ctttaatgggcacagaattggctaaagctactttgccatccttccttgcttttcactctgttaaaatatcattgctttgaaaatgctgaaaggaaagtcttactaggtgtttgttaacttttgtttttagtgcttatgtataataatcatctcaaaaatgtattgagtgcctcattttgtccaaaacactgtaatactgaaagtaggtcttgcaatctttataactactttgttaaccataatttttttgttttacatctttctttgaatatttcctcttgtcccaggaggtttggttatttaggaacaatctgttatttgtttatttaatgatttgtggagttcccatcagagtgccatctgggtgctgtttaaatctaatgtgcaaaattctatgagacaaattgtttttgagattggataactaagtctattattcagtattaacatgtcatttggct

SEQ ID NO: 261028 - DNA, 456 bp, Homo sapiens
accaggtaaaatgatttcatgaaccactgatgggtaaattgaaagctagtgattataggacagtggttgccagtcttgtatttcatgggtcagtaaaatttaaaagaaattttggggattgatgtaagatcatctgtttttcatgttgcaaagtaaggatgttttaaaacaaggtagctgggcgcagtggctcatacccgtaaccccagcactttgggaggccaaggcaggtggatcatctgaggtcaggaattgagaccaacctggccatcatggtgaaaccccatctctactaaaattacaaaattagctgggcgtggtggcgattgcctataatcgtagctactcgggaggctgaggcaggagaatcacttgaacctgggaggcggaggttgcagtgagctgagatcgtgccactgcactccagcctggatgaaagagcaaaactctgtttca

SEQ ID NO: 261029 - DNA, 440 bp, Homo sapiens
ccatgagacctgggcactgtgtgccccagaacatgtgacctcaagggggtcagagacttgggtttttcctttcaggatctatgcacagatcttttttagtgccataactggcctctgggttccccactcctgtctcagtcccaactttaagctacccttagattcacaaggaacctgactcaggagagaccacctcctgaccctgcccagaggcagcttaaaaacaacctagttcttcagtctctggaccatgctcctggcctcctcccacagagcatttggaaagcaacccaaggcaatgttcagtcttccctgaacatactcgaatacccctcaaacctctttttttcttaaacaggcaactcacatatgcatctataacctgtatagatacgttgacacttggaagcaaaatagaggaaagctttcattatcatttg

SEQ ID NO: 261030 - DNA, 604 bp, Homo sapiens
taggtttgtcattgtaatccctgggctgcttaggaggataccatttggtttgatgaaaaagctggaatgataatagctcaaactcttttgagcatttagtacatgcttggcactgttctatatgtcttaagttattcactcttgtatttaaccatcaacactcttatgaggtaaatatcccgcaattacttttgcgccaacctagtaccactacagacaaggaaacagatgcagagaggctaagttacaagggcacacagccataaactttggatctgtggagtgactgggcttcagagtcctcttcctgactgctgttcctatgtcttttgcaaagagaagtctttgacaggtatatgctttattaaaatcatgtttagaaagaaatgagagaatagaattagaaaaaggaatgactgtaggcttcgatgaaaatgacttttgtgactaggtgaaaattgtttggctgggtatcctggaaaattgtcttctgggaatatctatattccagggttcacttttgtcatagaattgtttcttggcccatttaagagagatactttgtttattaataaatcaaacgttttaattttaaaaaaaaaaa

SEQ ID NO: 261031 - DNA, 554 bp, Homo sapiens
gggatgtataagacaattgaaatatggtagcatcaaggttgttttgacctaagggcaggatttatggctagtgagggaagtctttcctgccaggagatgttcattgaagtgcagactgctcggagccacaccgcaggctggcagaggaagtgtctcggtgttgccttggcccgttcaccccctgccaggccagtagaggagctgaagagtcttcgccatggtttgagaaaaagcttatagaggcctgaggctggaggcagggggatcagtgaggaggctgcagcatcagtccagctctctccaagttcgctccagggcttgcgagaaacaaagtgctctccctcagccccagctcctcgcacacccagtggaaagaaaacacttgctgtaattggaaagccccgagaaggttgagagcacttttgttttcttcatctctgcgtccttatttcttggaacactacctggcaaaccatgggtgcaccatgcagcaagttaaggtcgccgaagtagaattgcgtattaagccagtgtctccatccaggtaagaaaga

SEQ ID NO: 261032 - DNA, 277 bp, Homo sapiens
tatgcttccttatgaactgacggtgactcccaaattcatatgttgaagacccaactcccaacggacttggaggtgggcctttgagaagtaattgggtttagattaagtcataagggtggagcccccttgatggtattaagtccttctaagaaaaggaagagagtctgagctctcctctgtctccaccatgtgagggcacagagatgtatgcttcttggattttgtttttaactcagtatgaaaaacatatattttaataagaaaattaccccattca

SEQ ID NO: 261033 - DNA, 375 bp, Homo sapiens
aaacacctctatagcatgcagattaaataaactcagccacagcctgttgtgagattcttagggccatgcctgataatggcagcaaaggtagaggcatggatttttctgagagtaaagactcagtggttcctgggagaggaatttgtgtttgtggttggtggtggtttgcacttcatctcataggcacatagtgtacaaaagcaaataactgctgatttctcagtctgagcctttctggttgaatctgaatcatcttgagtatgagcatcaaatgttatagaacagcttttgtatcgggaacatcaacaagggtcctggtagcaggacatagacataaatatctaatagcattggccaatgcctccatgggtagta

SEQ ID NO: 261034 - DNA, 290 bp, Homo sapiens
gtgatagtgagtgagttctcatgagatctggtggtttaaaaagtgtttggcagatgtgttcccaccccgcccgcctccatcaccttgtgaagaaggtgctcttttccccttccaccatgattttaaggtttctgaggcctctccagccatgcagaactgtgagtcaattaaactacttttgtttataaattacccagtctcaggtggtacctttgtagcagtgtgagagctaatagaggtatcagagagattttcattattcttgtgagattttcccaattgaattgaca

SEQ ID NO: 261035 - DNA, 2139 bp, Homo sapiens
gaaaaaggcattttaagatagccagctaaatgccagaaagttgtaaaatggctttttaacttagcttatttcttaattagattactggttttagggtggagccctttaaggaactcagcctaagaaagcagtcagtcttcagggcctaaaggatgcttttcttatccaaacactcaaagaggagcaccctgtagtaataactgttcactgtaagcaactgccatcagccattctaaaagtgtatttctcacctagccatgacacataccaaggttaatttttttcataaagtaatttctggtaccccccaaagccaagaagatcaggaaatgcaatacaaaagggaacagaattttagatctgagataactccgtccatttacagctttggggattccctaaggaaaaatagcagttactaccaaaaaggaacatgtggcacctttttctgttaatttctctttttttttttttaaggcatcaagttgttagaatttactatgtatgtgtctgtctgtctgtctatctctatctatgtatctatgtatctatctatctatctatctatctatctatagagactagcctaaatataggttttaattaagtcaacttttgactatagagctcttaaaaaatcctctcaaacctcttattaccagaatttgccagggacaaagagttgatattttaaatcacacaactgtcaaaccagaaaggacttgttccctggccaggaattgaacctaggccaccacagtgaaagggcagaaccgtaacttctggacacagaatggagtgtctccgttgttcttcccagaaggaatgtaaagcaggcacttttgaccttgaataggattttaactttgttttaggtcagatctgctcgaaagaatagctataacattactttgtgtccctttaatttaacctttccaacaattgtttagaataaaagatgggggtctcgctttgttgcccaggctaatctggaactcctgggctcaagcgatcctcccgtctaggcctcataaagtgctagggttacaggcatgagccaccccacctggcccaatttgatacctttaatctgagaaagtttttagggtaactttaaatcttgtcggcaaatagaaggtggaaaattattaaacattgaaaggatacttcctattaatattctctatttttttatcctcaatatttatttctactccagtattttttgtttgttttagtaatctatttagagtaacaataaagcaggtgagtgaaggagcacaaggaacttcatccccaattaatctgccttttatcagttgatttttcagtgaaacttcagagggcaaagtggaagggtccccttggctccttcatgataacctaatctgatttgtgccatctgcggcttctgaaaaaaaaaatctttagtgggacagagaaataattaacatcttccatgaggtttctttttcctgtgaagaccaagtatgattctgttttgggaacattctgtaattcttcatagatttttaaattagaaggggagtgtcttagtttctcttatttatcctcctcctttcagaggagacagcaagacccagaaaagtgaagaacctgcctgaacatggtccagtggcagactcagaagtggaactcaagccttttgcttgtcccccccacgtttttgatgcagagtttttatagctcctcaagggaggaaggaacagaagggaccctgcagtccaaggtcagtggtttagaaagttggtagttgagaaggatccatgtcacactccctgtttcctgagctaccccaggaaacacagagaagagtttactcagtgatcagagagtcaatggaggttttctgagtcaggtaaccaggattctgaagtttgtgttttttctaaatctgggttgttgatggagaagtagactggattttattaatacttgcaagacacagggtacatttttttcagtggttttctttcccttgtttgatttttataaaggtacatcatagtttgaccttctaaaggtacaagctgaggagtacattattcatcaggggaaatttttctagggcatctgttttcgaaacataggcctaggattgtgtgggtcctgataagc

SEQ ID NO: 261036 - DNA, 517 bp, Homo sapiens
caaggaggccataaaaacctatggtcatggctttgagtccaagtcagtgtggatgcagccagtctgtcatttttgggtgtttcctctgtagccgggtctgccatatggtgatgtcccagctctcgtgctatgaagttaaagcctctttctcaacaggctgcagatgatcacccaggaagagaatgcagaatgcccaaagcaaaccatctcagctggtcactgcttctgtgccaagaagggaggcctggcgaggggccagtcaggaagcagcatggcatcacatgctcatgacccacatgaaggtccctttagacttgtgtcaacaagatccattttctgaaacaactatttttgttctgattataaaagtaacattggctcattggtaaaacttggattgtgtgagaagtctacagaaataaatacaaatcctctagaattccatccccaaaagtaaccactcagacaaatgttctaatgtcatgtaaaaccatattaaaccatcttttctagctgc

SEQ ID NO: 261037 - DNA, 355 bp, Homo sapiens
aatcacgtggctgtacccattttacagacaaggaaattaagacacatcaaggttgagtcacttgcccaggctgtgtggctccaaagtctgcgttcataaccattaaccaggcttctccacctcagcattaaggacacttgggaccagacaagtgtctgttgtggggactgtcctgtgcattgtaggacatgcaacagcattccctggcctctacctactaaatgccaatagcaaccccagtcatgaccagcaaaaatgctcccaggcattgccacatgtcttttgggagactaaatcagccctatgagaactgtaggtctacactaaattgtttttccaagccaaataaatacca

SEQ ID NO: 261038 - DNA, 432 bp, Homo sapiens
gcccagtgattctccaagtgtggttcctgcatacacagcatcagtatcaactaggaacttgttaaaaatgcaacttttcaggccccatcccagaccttctgaatcaaaagctctctaaatggcaatctgtgtcagaaagccctccaggaagcccttatgcatgctgaaatttgacaaccactagtgcaagccaggggtctgcaaaccgcaagccgagagacaaatccagcccacaacctcttactgcctgaattagtccgctttcacgctgctgataaagacatacccgaaactgggtaatttataaagaaaaagaggtttaatggactcacagttccacgtggctggggaggcctcacaatcatggtgaaaggtgaaaggttcctcttacatggtagcaggcaagagcgaaaacatgcgcaggggaactgc

SEQ ID NO: 261039 - DNA, 2903 bp, Homo sapiens
gattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctggtaagaagagcctgccatttcaccaaggggagaaactgctatgagtatgtggatggaaaagataaatcctgggccaactggatgaggtatgtgaactgtgcccgggatgatgaagagcagaacctggtggccttccagtaccacaggcagatcttctatagaacctgccgagtcattaggccaggctgtgaactgctggtctggtatggggatgaatacggccaggaactgggcatcaagtggggcagcaagtggaagaaagaggaaccaaagccagagatccatccatgtccctcatgctgtctggccttttcaagtcagaaatttctcagtcaacatgtagaacgcaatcactcctctcagaacttcccaggaccatctgcaagaaaactcctccaaccagagaatccctgcccaggggatcagaatcaggagcagcaatatccagatccacacagccgtaatgacaaaaccaaaggtcaagagatcaaagaaaggtccaaactcttgaataaaaggacatggcagagggagatttcaagggccttttctagcccacccaaaggacaaatggggagctgtagagtgggaaaaagaataatggaagaagagtccagaacaggccagaaagtgaatccagggaacacaggcaaattatttgtgggggtaggaatctcaagaattgcaaaagtcaagtatggagagtgtggacaaggtttcagtgttaaatcagatgttattacacaccaaaggacacatacaggggagaagctctacgtctgcagggagtgtgggcggggctttagctggaagtcacacctcctcattcaccagaggatacacacaggggagaagccctatgtctgcagggagtgtgggcggggctttagctggcagtcagtcctcctcactcaccagaggacacacacaggggagaagccctatgtctgcagggagtgtgggcggggctttagccggcagtcagtcctcctcactcaccagaggagacacacaggggagaagccctatgtctgcagggagtgtgggcggggctttagccggcagtcagtcctcctcactcaccagaggagacacacaggggagaagccctatgtctgcagggagtgtgggcggggctttagctggcagtcagtcctcctcactcaccagaggacacacacaggggagaagccctatgtctgcagggagtgtgggcggggctttagctggcagtcagtcctcctcactcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcgataagtcacacctcctcagacaccagaggacacacacaggggagaagccctatgtctgcagggagtgtgggcggggctttagagataagtcaaacctcctcagtcaccagaggacacacacaggggagaagccctatgtctgcagggagtgtgggcggggctttagcaataagtcacacctcctcagacaccagaggacacacacaggggagaagccctatgtctgcagggagtgtgggcggggctttcgcaataagtcacacctcctcagacaccagaggacacacacaggggagaagccctacgtctgcagggagtgtgggcggggctttagcgataggtcaagcctctgctatcaccagaggacacacacaggggagaagccctacgtctgcagggaggatgagtaagtcattagtaataaaacctcatctcaatagccacaaaaagacaaatgtggtcaccacacacttgcacaccccagctgtgaggtggcttcagcggaagtctgctgaccccttatattccccgagagtataaagagatcggaaataactgattaaacaaatccgccactttcatgactagagatgaggaagaacaagggatagttctgtaagtgttcgggggacatcagcatgtgtggttctttcccgcactgatcccctccattttttgtttgtttttttgcctcctgttctaataaattttgtctccatacaaatctgaaccccaagtgtgtacctcattcttcccttatcactgaaggcaagaagagtccagaagggccacagagaactcatgtgttcagctcaagactccacaggaattcaacccccagaaagacataaacttggagtccgtctggtttaattattggagaatcgattcccaagtccaggaagagaaatgtaagattctagaaagtcgcagcaggaaagggagttccctggtctcctgggaagtgtggcttcttctcctaatggacacctctcctctgctgccatactctcccttggctccccagtctcctctcctgatctcctccaatctctgtagcccaagatgtgaaagccagacaagaacacgcgtgtgtgtatatatgtgttcgggtgtgggggtatgtgccctccgtgtaggtaactgtgtgagtgtggggggtttcaagggtgtgttaggaacaacgctcaaaatcctaaggaaactgaacactcgaacgaaggattcttagcaa

SEQ ID NO: 261040 - DNA, 658 bp, Homo sapiens
tgcgtgtgtatagatgtgtagagatgggagtctccctatgttgttcaggctggtcttgaactcctggcctcaagtgatcctcctgccttggccttccaaagttgttgggattacaggtgtgagccactgcaactggcctaacgtctacttttgaaatgagaatgggaaatacacaattgccaataagtgtaaataatactaaaagtgactttagttctgcatgatagccaattgagtagatgaagtatagaaaatatagggggatgataagaagagggtaaaattgggaggaggtaagggagagaaggaaatttagcccttccaaattctttctctagaatttagagaggatggctcacacctgtaattctagcactttgggaggccaaggcggacgcatcacttgcgaccaggagtttgagaccagcctgggcaacatggcaaaatcctgtctctacataaaatacaaaaattagccgggtgtggtgatgtgcacctatagttcaagctactcagaaggctatggtgggaggattacctgagcttcagaggttgaggctgtggtgagccatgttggtgtcactgcactcaagcctgggtgacagagtgaaacactctcactgcactcaagcctgggtgacagagtgaaacactctca

SEQ ID NO: 261041 - DNA, 207 bp, Homo sapiens
aattgggaggaggtaagggagagaaggaaatttagcccttccaaagttgttgggattacaggtgtgagccactgcaactggcctaacgtctacttttgaaatgagaatgggaaatacacaattgccaataagtgtaaataatactaaaagtgactttagttctgcactccagcctgggcagctagagtgaaacaatgtctcaacaac

SEQ ID NO: 261042 - DNA, 539 bp, Homo sapiens
gcagccgcctactactactaaattcccccccgctcgacgagaatgggaaatacacaattgccaataagtgtaaataatactaaaagtgactttagttctgcatgatagccaattgagtagatgaagtatagaaaatatagggggatgataagaagagggtaaaattgggaggaggtaagggagagaaggaaatttagcccttccaaattctttctctagaatttagagaggatggctcacacctgtaattctagcactttgggaggccaaggcggacgcatcacttgcgaccaggagtttgagaccagcctgggcaacatggcaaaatcctgtctctacataaaatacaaaaattagccgggtgtggtgatgtgcacctatagttcaagctactcagaaggctatggtgggaggattacctgagcttcagaggttgaggctgtggtgagccatgttggtgtcactgcactcaagcctgggtgacagagtgaaacactctcactgcactcaagcctgggtgacagagtgaaacactctca

SEQ ID NO: 261043 - DNA, 310 bp, Homo sapiens
tccaatcatgaaatcctttctactacaaaataattttgtaataagaagttgtttgaatgaaggattctacgatgtatttgatacatattgaaaacactttcagttcaaagacattatgtcctggggtagaaaaccggtgtcagaaagactgtatttaaaccataggtacagtctttccattgttgaatattattattattattactaatttttaaaatggtaataaaaatggcaggtctttccagctgccatggactttacttctctttattgttttatactttccctgattcataaatgcatgtcatct

SEQ ID NO: 261044 - DNA, 1151 bp, Homo sapiens
aagcaggaactgcgacacgctcccctggcccaacctatgacatgaactagagtgccccaaaaaatcctctatttctagacccgtcagtctgggtaaacctggcctctggtgaaggtcctaaatctgtttccccatgccccgctgaccacagtaagtccctggaacagggaaagccttgggctcagggatggtatatcaaatggcagttgcatttctcatattttaggaatgagatggataagaaagaccttctaatgtaatcccttcattattcattggcactactcaaaccccaaagtctctaggttgtttttctactccctggatatatctatatgataattttttgcctggagtagactccatttttctctattaggaagatgaaaactttctgccagaaagttgcccttttaattactttctgggaaacactctaagttatgtgctccacccagctccaggatgaagtttttctgcttaatagcaatgacaggctggtctcatactcctccaagccctctctgctttctagtgatcaaggggtttcaagaccttatggtcttatttatagtctgtaaaaatatgtctaaatatatgtataaataatcttctctcttctgaattcctttcttaatcacaagagccactactgggaacgatattttcaatttggttaatcaggagatttcgtgccagggatcgtgaccataattaggtacatttgggtaaaacttttattagtttgacattatcagtaccagatttgaaatttaacacaagcaaatctgcaggccaattataagcatttataccacagtcctttgcatatttgtttgcataaactctaatccctacatttttaggcatctattactctaaaatgctccctatttaatagggcctctgttgcttattgttttcctatcattctttttatctcaattccagtgttctttcttcttcatccttagaaagagagtaagaaatgagatacagagcaaagacaaaatttagaatacagagaaagcaagaaaaaagaatctaaagacagccaccaaaacagaatgaaaggtgtccctggtaacctagtgtggaaagcatgacagcatctcttcacctctgcacccacaaaaaattgagaccaaagg

SEQ ID NO: 261045 - DNA, 666 bp, Homo sapiens
ttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcacttactgtataataaaataatcttacagtagtatatctctatttcct

SEQ ID NO: 261046 - DNA, 667 bp, Homo sapiens
ttttaggtttaaattactaacttactatttgttgtttattctatgtcttctttgttctccttttcttctttttctgctttcccttagagtagctgagtgtgtttatattacatattgtctcctttgttggcttattaactgtaaatccttgtcatttgattccttgagattttatagcatacatcattgtgagggattgcatatttatgtcctctccaaatttacatgttgaagtcctaatccctaagggatggcattaggaagtgtgacctttggaaggtaattacatcttgaaagtggaaccctcatgatgagattatgtgtcttatgagacaacacagaagagagtttgttttctctttctctgctctttgccatgtgaagacagaatgagatgaccatgcataaaccaggaaatggactctcactggacactagacctgccaacaccttgattgtgttttagagtccagttctagagactcctcagcctctggaacgtgagaaatgaatgtttgttaaggcagtcagtcagtctatggtgtattttttctagtagcctgaactgactgaaagaaaatcatgaacttatcattctaacttcaaggacattatatcaacaccactataatacaataatataccaactacaaaacaaaaaaaacac

SEQ ID NO: 261047 - DNA, 351 bp, Homo sapiens
ctctttgcatgctagacctctttgcatgcctctgtgcatgctagactttagaacaggctagtagtatttagtattaataatacttgaatcattgtgtaatttgcagaattaagaaagttacacacatatatatgaatgaatcagtctgcttagtattaggtggggcttggaaatcagtttatattggagtttttcctaaaatttcagagaaacttcaatcaatccttttggacaggaggtggagattactgtaaaaggtgaaatgagctcctgagttgtatagttgtccacagcagaaatgaaaattagagggcacatgtcctcaggacctcctgatgctgtgtcatgttt

SEQ ID NO: 261048 - DNA, 501 bp, Homo sapiens
gaaactacataggtacatttatgtatatatacatatgtggatatatgtatctataggtttattccatcaccaaatatatgtgtcagagaaataaggttggacgagtacatatgaaacaggctatcagtgattatccctggagaagaatagaggtagaagtagcagcaaagttctaacttgaatcttattgaatggcttaggtcatatgcctgtccctgagccaatcactgtggccagagggttaggatgctcttattaggtgggcccctcttaagccagaggtggagtcaattctacttaaactgcatggactaacaactagggaagggtggttgcatgaagaaaaaccaggatgctgtttccagaaagggtacgagatgccaggcaataaatacagcacatatccatgataatactctcttggatgtcttcatttgtttacaatgtttgcataacactttactgtatataatagctctaaattaccatagcttaaaaatt

SEQ ID NO: 261049 - DNA, 251 bp, Homo sapiens
ccgggccagctggactgcagtgagtgcaggggaaggcaaggacagggctacaagcttcccccacccttggccagggggctccccagcactgggcagagctgtggcctgcggcagggtcctggccagtctgtgaaattgactccagcacctcggggaagtttgtcctcagctccacgtggggcaagaacaggagctgggctggggggaaaccgggagaccttggggtgggtagggagagaatccagcggccg

SEQ ID NO: 261050 - DNA, 464 bp, Homo sapiens
gtttgagtcaacatttgaaaatcaattaatgtagtccactatatcaacagactaaagaggaaaaatcaggcggtcacattgatagatgcagaaaatgcttttgacaaaattcaacacggattcaggatgaaaaatcctcagcaaactaagaataggggtaacttccttgagaaagaacatgtataaaaaaacttgttgttaacatcattacttaatagtgagaaattagaggctttctcactaaatcagaaacaaggtaaggatgttccctctcccaatttcttttcaacactgcagtggaagtcacagcatgcaacaatacaagaaaaggtatacaatacaagaaaaggtatactgattgggaatgaagaaataacgctgtctttgttcacagatgacatgatcatctatgtagaaaatctgaaagaattgacaaaaagactcctggaactcataagtgatta

SEQ ID NO: 261051 - DNA, 462 bp, Homo sapiens
aaaagaagaaaaaaagtgttatgttgctagcttgccagatgaggaggaaaacaaatggtattccaactcaacgaatgaggaaacaaaacctcagagaggttaatgactacatatagatctagacctgtgtgaccttcccaacacccaggagagacagacacagtcacatccccacttacagatgaagacttcaagacgcagagcggtggagggacttgcccgagtcctggagctgggagaactcccgagaccctgggatggtggcatggcccctgcacctccgctgcctcccccatggtgaaagtacagcacaggcggggctgcgagagagcagcggagagattatgcagtagctatctttggaggcgtcactgcccacggtgtttttaggatgaataattgcttgaattcctcaaggctttataaatagatggagaggtaattatacacagcaggacaaaa

SEQ ID NO: 261052 - DNA, 363 bp, Homo sapiens
ggccgtacaatcaaagttaaatatgacttaagaatactagtttttaaaatgaaaaagtaatacatacacacagaaatttcaaaagggtatagaatgaaaaatgagtcttgttcctgaaacacaattgcttatttctgatttcttgtgtgtagcataaaaaaagaaatattctagaaaggctataacaaatgctggtgaggatagggagaaaagggaactctcatacactgttggtgggaatgtaaattagtacaaccactatggagaacactttggaggttcctcaaaaaactaaaaattgagccaccataagatccagcaatcggactgctgggtatctacccaaaagaaaggacatcagta

SEQ ID NO: 261053 - DNA, 332 bp, Homo sapiens
gagcaaccatgtggattccttaactggaggaaccaggaatcaacatacataatatagatttccaccttttcttcttcctatcaagaaatctaaatggagtctttaaaaggttcctgttttgggaggggaacaacacacactggggcctgtcggggtggtgctggggaaaagagagcattaggaaaattagctaatgcatgctggtcttaatacctacttgatgggttgataggtgcagcaaaccaccatggcacacgtttacctatgtaagaagcctgcatatcctgcacatgaaccccagaacttataaaaataaaaataatttaataaaa

SEQ ID NO: 261054 - DNA, 483 bp, Homo sapiens
aactatttgtagtaagcagaataatgcttcccctgtacccaaaggtagccatgtcttaatcctctgaacctctgactatcttatcttacatggcaaaggggaattaaggttgctcatcaactgaccttaaaatagtgagattatactggattatctggtgggcccagtgttatcacaagggtccttaaaagtggatgatagaggcagaaaaacagagttagagggaaacgtgactatgggagaaaggcacagagagagacagtgttgctggatttgaaaatggaagaatacaagccaaggaatgtcagtggcctctggaaaagagactggaaaggacaaggaaatggattctctcatatacctttcagaaaggaacctatccctgctgaaacctcgattttaatccagtaagacctattttggacttctgacctatagaattataagataataaacttgtatgattttaagccaccaaatttg

SEQ ID NO: 261055 - DNA, 387 bp, Homo sapiens
agctcgtgccaggggtctcagatgatggacagacactgatatggaggttcaaatttcgggaaacacagcaacagcccagccatggtgcgtcttggagaaaaccctagacaaggaggttcttttgcaagccgagtagaagagtggcatcttggcttgttgttgtctggggcaaaaaaaaaaaaaaggctcaggccctggagagacaattggggcctcagtgggtgccccaagagaggagagaaacttgcatggagacccaagagtgctgagcttttggccgggcacagaggctcatgcctgtaattccagcaccttgggaggctgaggcaggaggatcacttgagcctaggattaagtttaagattagcctgggaaacccatctctac

SEQ ID NO: 261056 - DNA, 689 bp, Homo sapiens
ccagaagttaagtattccgtgttgaacatgtgagagtaggaaaaacagtttgtttttttcctatctcatcaaagagccaaagtggcttctcatgggcctacaaaagatagaataaagtatagcaaggatcctcaaattctaacgcaacaatccccttcgtgtgccctaccggaagttcactccctcaaaccatgatttagtcttcacttgaccttataaagggcagtctgttggaagttccaaacccagtactcttcttttctttctctaatttctaaaaaaccttctaggtaaggttttgttttttttttttttttttttttggcaccaccaggcaaaaaaaaagggcaaaaatcaaattcatcctgactggtaaaggaacttaaggaaaaaaaaaaaatggggcttggaaacagagttatgaagcagccatgcgtggcccacacaggccacatttaaacaagttgtatacttttgattggatatccaagtacaattgatattgtggacttgagtcaacaggcataggcaaaaaatgcgactctacttgtgtaatcctgggcaacaacctttctcattctcagttttgttatctgtacaatgggtatggtagtgtgtgactggcccactctgaaggttcttatggccagactatgaaacaaagtgtatgaatgacacatgaggcacct

SEQ ID NO: 261057 - DNA, 399 bp, Homo sapiens
ctcatatctattcagccctttggccactatgttcacagtcagcaaatctgccagttttcataaataggaatggagaatctggaaccatccttgcacatctttgctccaagatatatttccctccagtggacaccattatctttgaaaatccccctgagcacaggaacctggccaaagaagacatggagaactcactctgaaaggaatcatggctaagccctcagcaccaaggagctgaattccctcagaagtcacctacaggccacgccacggaaagcaccaatgtgtgctctggaaccagctagacctgggttcagttcctaaacccaacatttaccagcgctgggcgaccctgggtgaggtccttattgttcaaagccacagtttactcatctgcaa

SEQ ID NO: 261058 - DNA, 433 bp, Homo sapiens
gttaacttcattatattcaagtttatatatgagtgaaacttctgggaaaaaataactcatgagaaaactcatgatgtcaataacaatcaagttccaaattttcagataattatattaatacagggctagaacagctttctcagcattcaaaacaagccatgaataatttaaagaaaaaaaggaaaaggaacttgtgagctctaagctgggttgaatcatttatatgcagatatgtgcacacacactcacattataactacaaaacacagaagtgtggtatgtccaacaaccaccattctatgtattataaattaggccaaaacagaatgaataagaatgcacattggccaggcatggtggcttacgcctgtaatcccagcactttgggaggccaaggtgggcggatcacgaggtcaggagatcgagactatcc

SEQ ID NO: 261059 - DNA, 347 bp, Homo sapiens
ataaagagtataagactcagttcctaaaatgaagaaacttacaatctagttgagaagaaacaatgctttacatgtttctcctttataattttttgaagtgatttcaaatacttcataatatttgactttgacaacaccattcatccatttactcaaaagtatgtatgaggctgggcacagtgactcaaaagtatttatgaggctgagcacaggctggggctgtgagcacaggctggagctctaatcccagcacttttggaggccgaggcaggagaatcgcttgaggccaggagtttaagaccagcctgggaaacatggtgagacacctcccatctctataaaaaata

SEQ ID NO: 261060 - DNA, 525 bp, Homo sapiens
cagtgtagctgcacaccccacaccccacttcctgctgcagtagaagaaccccaactcctctcccatcgggtctgaaacacagaaagctatgggtgtgcctgagatccatcaatgcatgcactcaagcagaacagaggactacatatgagtctataacagggaataatgtccctgtacaaagtagtaagcccagcacatgctgtgagggctctttatctctctcataaggaagtgttctggacccaaggcccattcttatatgattgggtggaggctgaaaaactacatgcacaagactgcctttcccaacatcaataataaaaatttgagcagaaatcaatgacattgaaaatgggaaaccagcagagaaaatccatgaaaccagaaattgactttttgaaagatcaattcctttaggttgcccacagatagacgttacctgcagccaatatacatgcttgtgctagcagagggatgcaagaccaggtactcctggctacagcatagtctaccaattagcttgct

SEQ ID NO: 261061 - DNA, 416 bp, Homo sapiens
ggtcaaggggacggctacgcgagaatgggggagtggggcgcccgaggctgctcctgggccctgggaagcccccgattaatgaatggtcgggtcagcgacgcgagggtcggggtttctctgaggaccgcgcgctgcacctgcggagccgggtgaatggatgtcgcgaaggcaagggctgcccttacccctcggggccgacctcggagccctcgcccgtggttgcaacgctttcccgggaaaccggagaagccaggccgggggctcggcctttctgaggcggcccttccggcggaggacaccggcggaatttgagtgcacagagtgcgcgagaggagctccctgtagacacacagtccaagccacgtaggtaattctaatagcagccacatttttaaagagtaaagagaaatcggtga

SEQ ID NO: 261062 - DNA, 470 bp, Homo sapiens
tgcatagctggatgctggatcttcagggaaaatgtatttcccggaaatgattccggttctctaaaaagggctttattaggatcaactgcaaatccgatgggggccagatgtagggatcagagccatgagtgatttaccttaggactgtgtggaaggcatggcctgaggatgtcttttccttggaggtgtgagctgtttccaaggctcgctggacacagaggcaggcacgcttgagctattgcttgtgttattttgcgccaagcatcagatcaggcatgggtccttcgctcctctgctgcctcgtatgcacactgaagagatgctgggcctggaccaaggtagcagcatcgtcctcacggcattcatagtgtctttccccacctaaatcagcttccctgttcagcaccgtccagcggaaactcagtacacgccacatacagaatcatgcattttctaaaagcaagatttta

SEQ ID NO: 261063 - DNA, 657 bp, Homo sapiens
tagagtgggaggcaggtaatgcttagataatcacgcaaaaaattatagaccatggttatgtgctacaatggaaaatacagagtgctgtgaaactaacaggggaacatggcccaatacgtggggaaaggacggtatcagtcaagggaggcttcccccatggactaaccttaacgcgaagatggggatgctagggaagggaagaagaagatggagctttccaggcagaggggatagcaagtgcaaacaccctaagatggaaggtttaaggaagtcataaaagccaagtgtggcaggaacacagaaaaaagaaggaaagtggtaccgaatgagactagagaggaagcagggtcaaatcatgcagtgccttgtaggaaatattaaggattggggtccttattctaaaataaatggggaaagccaataggattttttttaaaagagacatggtctcactatgttgcccaggctggcctgtaactactgggctcatacgatcctccctcctcagcttcctaagtacctgggactacaggcacatgccactacactggcctaattagaagagtttaaataagtaagtggcatgaagaatttttttaagagcattatgcctagctgcctacaatgtaggaactggatgtgggaagaccggttagg

SEQ ID NO: 261064 - DNA, 504 bp, Homo sapiens
gaggttgcagtgagccgagatcacaccaccgcactctagcctgggcaatgggagtgaaactccatctctaagtaaataaataaataaaagccggcagtcccaaattacttctaggaattactgattgtgaaactgtatagcattatctagtcaagggaaagaagtaggcataaataaggaataattaagaggagtaagagtcttcttatgatggggagtcttattccaatggtcttgggaaaagttgtccccagcatgaagtcaacaacttctcatcctgatttgcagtttgattgtctctggtgtgacatcaggcattctggtgaattctctatgtggcacatgtatcaggtatgagatatctcccttgaaatttacatcgagttgtccagcttttgcttatagggcttgagaaacagccgtttttgttatttgagagtcttagccagatattagagaaaactagaagaattcagaatccagtctagtctactagtgaaaaaa

SEQ ID NO: 261065 - DNA, 665 bp, Homo sapiens
gcttattataaacatagacatggaaagaaagcactgaacaacggacaggttccgagatatctctgtgaatagtttcctccaggctgtgcgctctgccttctgtccctccgctatcctctcatcatttgcatgtctgtctacaactgtgcccttgtcctttctccatgagctgacttcctctgtttactcacgggtcctgctgtttcatggttttgagatggttcattgtgacttatctcatttgaattctacatcatgaactttgggtttcaattcccgttaactggcttatctctcagccatagtgtgctgaccaatccatgggcttccacctctgcctcatctgttttggttgggagctggaggccatgtgggaccaaacgttggcccaagtatccaggactatgcagggtattgtccctcagtagggactacgagcatggcaagcacattgaagtggattcatcccagcattagttttgttatgatgaagattggagcttttctctctccttttcaaataaaggcagagaaggaaggtgggtctgtaaggataaagacctttgtcattgttgtggtccaaattttcttaagaagagtcagcgtttttggaggtacctttttgttataatgatattgcttcctattctaattgcctgctgtcg

SEQ ID NO: 261066 - DNA, 520 bp, Homo sapiens
tcaaaataaagagaaaatcatcactgtagccagacaaaaaacatatgcagaggaataaatataacaatgacagtaaaattctcagaaaacatgcaatccagaagataatggagtgacaactttaaatattgaaagaaaaaaaaacctctagtcctagtttactgaaattgaaaaattatacccagggaatacatctttaaaaataaattagatgataatttagatgaaatggactaattccttgaaagatacaagctgccaaaactcacacaagcagaaagacactccagataagcctatatctattaaagaaattgaatcaataattgataaccttccaaaacagcaccaagcttgactaagctcactggtgatttctatcaaccatttaaggaagaaattataccagtactctacagtctcttctagaagatagaaacagacgattacttcctgactcattctgtgaggctaacatcaccctaataacaaaaccagacaaagacattacaataaaaaa

SEQ ID NO: 261067 - DNA, 691 bp, Homo sapiens
aaatcataaagcatgccaaaaatggtaaacctttagcttcagctatcccctcattagactttaccttcttactgtgtattattacaaagattgtgtctagaagatactttataatgatagaaggtattttataatagggtttcttatcacatatacttaatattcaacttctgtacatttaattttcatgtttcctcaagaatatattatacaaagtcatagcatttgacaaaattccttcataactctgaagaaaatattctatgtattgtttgtgtgagttaaatacagtggctctgataaaaatgtcttttgatcagtctttaaaaaaattaaactgaggacaggaaggtaaattaaaggggagatttggagacttgtggtaactggtttattgcaacttaatgtgcagcatcctcattagtcaagtatcatgtgcctacctaggcatgaaatagctatttttttcctgatttaaatctggaaagtttcagttgtagtacagtttgaatagttgttgttgtaaatagccactggactttttaaaaaagtattttttttcaaaaacagtgaaggtcatcttgtatccatagagaccacatgtactttcctcattatttccagcattatttatataatgggtagagttatttacaacattaaacaaaaagtatttcagagagcaaccgtt

SEQ ID NO: 261068 - DNA, 400 bp, Homo sapiens
gctctgcctcctgggttcacgccattctcccgcctcagcctcccgagtagctgggactacaggcgccggccaccacacccggctaattttggtgcatgtatttctatttttatttttcgtttgccatttcttccagtttccttggttaaagttttcagctaagtacttacctttatagtcagagataacgcctactctacacctgcaagtatcattctcccaccctaccttttctcctggctgattccagcaatgtgggactggctggggggtaaggggctagcacatggtacaagaccagctcccaagagcaagtgttgagtgcaaccactatggaaaacagtatagaggttcttcaaaaaacaaaaaattaattaaaaattaaagaattataaaaaaa

SEQ ID NO: 261069 - DNA, 573 bp, Homo sapiens
aggtttaattgacgcacagttctgcaggactgggagacctcagaaaacttacaatcgtggtgggaggggaagcaaacacttccttcttcacatggatctcatgagaacttcagatctcatgagaacttactcactatcacaagatttgcatggggggaactgcccccatgagtcaattacttcccatcagttccctcccaagacttatgaggattatgggaactaaaattcaagatgagatttgggtgggtttggctcaagatgagccagaccatatcatgaagttatcagtatgaattcagtttttaatagagaaggaaaaaaaaaaaaaatatatatatatatatattttatgtgtttcctagctctgtctgcctaaaagaaagaatatcacagttaataatgagcacctttacctcccagatactgttttcgaaatagcattctgcactctaaatagatcccaaaggatctagggatccctggaaaaatagctgatttcaggcctatggcagtaaaagcacaagctaattcttgattcttttttgggatgcaaaataaggatatactata

SEQ ID NO: 261070 - DNA, 632 bp, Homo sapiens
cttcctcggaactgttgcccacatgcagccccggacacagcccctagcccaaaccctacccttcttcctcggaggggcccctcgagacactgggctgcgggtgcctgtcattaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccagtaagattgtggcaagacctggcactcctccaagcttggcacagtgagcccaccagctcagatggttgatcttaccataccctcatagtaccaagaatggactgccccctaagaaacctgtttgagaatcactgaattaaaaatataatccataggc

SEQ ID NO: 261071 - DNA, 409 bp, Homo sapiens
ggttaacacaagctgcctatagacggcaaactaaaagagcaccctgtaacacctgcccactgggacgtcagttgtaaacatgcacccctagacactgccatggcatcgaagccccacagccttgcctgtctgtatgctcccctagagatttgagcagcagggtgctgaagaagcgagcgacaccccatcacatgccctgtgagggggacaagggaaccttttctgtttcactaggatgacgagtgtctcctcaacaaaacaaacaccaataacaaaatgaataagactatagttaaacatatctagactctggacccagaaatcaagacaagaaagataattttgtgcatattgtacaacatctctgaggctcagtttcccaaacatggattctacaagtggagtattg

SEQ ID NO: 261072 - DNA, 254 bp, Homo sapiens
aagaatataagttaccaattctgcaacctagagaccaaatttggccatcagaatagctatcattaagtcaagaagagccaaaattattcaccttaggacaaattaaaagaaataaactacttctgaacagatattaacggcatggtgtcctgatatagtctcaattccttatgctaatacagtaaatgcacaggagctgctgatttaaccttatagtaccttagtttccacaaatgaggaaaaagtttaggaat

SEQ ID NO: 261073 - DNA, 972 bp, Homo sapiens
cagacaagtgacagggaatggattccaaacaccagtgtgtaaagctaaatgatggccacttcatgcctgtattgggatttggcacctatgcacctatgcatctcaggaatatgatgaatgtgaatggaatgtgtgcaaaattaacttgtaattgttatgctctcatttccacatcttctgtcttttcttgataaagcttttaggtggacctctgaagtacttgatttctgtatttgcttaacaaatatttgatgaacactatgtatcaggcacgtgggtcagggcatgaggtataatgatatagaatatactttaccgattttatagccaagagggagagagaaacattaaataaattatcacacatcaatattttataagtgttattaaggaaaacagtgtaagatgaaagtatttattacaggtgtgagccaccacccccagccctagaatttattttactgactgtttgttggaattgaactttctcagtttttgtttttgtctgaaaatgtattgattttgccttcttttatggaatgggggtggggaagagtgaaatttacaaagagtgaaatgcacagattataaatgtataatttgatgattttcaacatgtaaagccaatgacccaattatgatacagaatattcccatcattccagaatgctcccttgggccctcttccagtcaattctgcccgtctactctctataggcagccttttgtcaccatggattacttttgtctgttctagaacttcatgtaaatggaatgtacattatgtactcttttgtgtcttgattctttttttgagagtcatccatggggttgtttgtatcaatagctcattctttttcttggtgaatagtatttcgttgtatgaatatatccattctccttcgatggacacattgattgtttccaactttgggctattatgaataaacctacggtgaacattcatctata

SEQ ID NO: 261074 - DNA, 772 bp, Homo sapiens
ttcataaccccacagctcctaagaattctctaacctgccttctgcccttaggctccggtagattgcaaacgacctgctttctttctgatcccgggctgcgttcggacccctgtcgtatagaaaatcccaagctcccgtagattgcaaaggacatgctttctttgtgatcccgggctgcattcggacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatgtaagtttagccatatttttttttctttaaagtttttcttttttccttccaaggataattggatgcttcaatttcttatagatatgtatgatag

SEQ ID NO: 261075 - DNA, 470 bp, Homo sapiens
cgctgtcattttttctaatatctattctctatccttccctaacaatttcttcaaagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261076 - DNA, 424 bp, Homo sapiens
tccacctcctgggttcaagggattcttatggctcagcctcctgagtagctgggattagaggcgtgcaccaccacatctggcaccctcattatgagataagtcactttttaaaattgatatctaaacaagtgttttcttaaaattttcagatacactggaattcgcaataaatccagtatggtggttatagatgtaaaaatgctatcaggatttactccaaccatgtcatccattgaagaggtaaataatagaagcctaatctttcagcacaaagacagctacatagagtataaagataaaataaatacttgttcagccatagtttagcaaaacaaaactatagaattcttcttcaacattcacctttgtatttttgcgctaacactggagagctggtttacttaatttgtaccaattagcagtc

SEQ ID NO: 261077 - DNA, 788 bp, Homo sapiens
gcagagccaccacaggaaaccaggaggctaggtggggtggaagggagtgagctctccggctctcaggagcgaaagcttccaagttgggctctccccttggccccttccacccaggaaagacagctgggtccgccaggaccaagaatccccaaaggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacaggggtacatgggcagggtggtggtggtgagagaattgcctgaatcagctgccaaatggtgcccaggttggaaaagcaaatgtgcacacatgggttcttcccactctaaccctgaggaattagaggcctgcttctgacacagactgggcagtggctagtgactctaggtatagagtatccaggccctgctcacccaggctagagcttagggagccagaaggaaggaggtgcatgttggggtgcaggacaggagggaaaaatactcgaattgcaaggtgagggcacagtctatttatattgggttgaattaactcctcccc

SEQ ID NO: 261078 - DNA, 1118 bp, Homo sapiens
ggccaactgatctccaaccatctgaggaacccaaccgtaggtgtgggaaccgctgagcggaacaccctcccccagcgggaaatccgggacacgcaggagcctcagtgaatccgaccattgtctcatctcaccaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261079 - DNA, 1035 bp, Homo sapiens
ttcataaccccacagctcctaagaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261080 - DNA, 969 bp, Homo sapiens
tcagtccccgcctcgcggggggtgcctcccccctctgcgatgggggttccaagagccagggggggaagaggggctggctcccgtagattgcaaaggacatgctttctttgtgatcccgggctgcattcggacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261081 - DNA, 1496 bp, Homo sapiens
gcagagccaccacaggaaaccaggaggctaggtggggtggaagggagtgagctctccggctctcaggagcgaaagcttccaagttgggctctccccttggccccttccacccaggaaagacagctgggtccgccaggaccaagaatccccaaaggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacagaggtgtgggaaccgctgagcggaacaccctcccccagcgggaaatccgggacacgcaggagcctcagtgaatccgaccattgtctcatctcaccagacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261082 - DNA, 943 bp, Homo sapiens
ttcataaccccacagctcctaagaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccacagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261083 - DNA, 1128 bp, Homo sapiens
ttcataaccccacagctcctaagaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttctggacacctaaaacccacagtcctccagacgacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261084 - DNA, 884 bp, Homo sapiens
tttctttttaaaaatgttttaatttttgtgggtacatagtaggtgtaaatatttaccgggtgcatgatacaggcatgcaacgtgtaagaatcacatcagggcaagtggggtatgcatcacctcaagcatttatccattgtgttaccaatgatcgaagtatactcttggttattttaaaatgtaaaatcacattactactgactctagtcagactgtataattcttaatacaggatgggttttcttataatttgctatcctttctaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261085 - DNA, 1518 bp, Homo sapiens
ggccaactgatctccaaccatctgaggaacccaaccgtaggtgtgggaaccgctgagcggaacaccctcccccagcgggaaatccgggacacgcaggagcctcagtgaatccgaccattgtctcatctcaccaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatggttttggtcgagcagacagtttccctttttctgttgagcagagcaaccttgtgttcaacattcagccagccccagccatggtctacgattactatgaaaaagaagaatatgccctagctttttacaacatcgacagtagttcagtttccgagtgagacaaagcaattactagaagaggtgaagaaattttattacgtcataaaccattgaaaacacatctagtaagaaaatgaaaacctgaataagataggacagtagttgaagaaagaaaagtgtctggtacttcattagacttgtgtagctgtgtactgcatgagtaatctgataatcattaagattatattaatttctttaaaaatagctttaaagaattcacagctatatatgtaccttttataaatctctcatttttgttttgtaagttgacaggtcagtaaaaatttaggcatatatatttgtacatatgtgtgtgtatgtacatgtctatgtgcctatatatgcatgtttttatatctaaatatctatttatatatacatacaaacgtgtttattgtttaaatgatgttttaaatcccagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261086 - DNA, 1508 bp, Homo sapiens
gcagagccaccacaggaaaccaggaggctaggtggggtggaagggagtgagctctccggctctcaggagcgaaagcttccaagttgggctctccccttggccccttccacccaggaaagacagctgggtccgccaggaccaagaatccccaaaggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacagaggtgtgggaaccgctgagcggaacaccctcccccagcgggaaatccgggacacgcaggagcctcagtgaatccgaccattgtctcatctcaccaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261087 - DNA, 993 bp, Homo sapiens
ttcataaccccacagctcctaagaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagcttgaaaacaagggccaagtgatgaagactgaagtcaagaatgaccatgttcttttctacttggaaaatagcaaccttgtgttcaacattcagccagccccagccatggtctacgattactatgaaaaagaagaatatgccctagctttttacaacatcgacagtagttcagtttccgagtgagacaaagcaattactagaagagttggagaagcatttcttgtaacaaactgattcttctgtatcaaacctggaaaaaaatcatgaaccatctgacatcgtgaacagtctgcagtgggctatggtttcttgtcaagtcttatttccttatcatcccattaaatgttgtcattttgcaaaaaaaacaatgac

SEQ ID NO: 261088 - DNA, 1305 bp, Homo sapiens
gcagagccaccacaggaaaccaggaggctaggtggggtggaagggagtgagctctccggctctcaggagcgaaagcttccaagttgggctctccccttggccccttccacccaggaaagacagctgggtccgccaggaccaagaatccccaaaggggctgctcccagaggttgtgttgcagggactggagagaggacttcccagtacagggggtggccctctgatcaggtgggggtgggtggcagcagagcatttggtaggaggtcaggagctcacaggagatgggattctgccgatgcctgctgaatgaatgagggagggagacggcaggaccagggactggggaattggtactaaggtgctgggtacctgccgggcactctgtccatacatgatctcagttcagctctccaccttggaaacacaagaaaggagccgtggctgcagagaaaaacagaggctggaaacagaggtgtgggaaccgctgagcggaacaccctcccccagcgggaaatccgggacacgcaggagcctcagtgaatccgaccattgtctcatctcaccaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccagacccctgtcggatagtaaatcccaagtaaggtaccttctgctggaagatctgagctttcttcttggacacctaaaacccacagtcctccagcagtgaaggatccagtgagattttccaggttaacggtcataatcgcctactggtccaacgttcagaagtaacacaggcacctggacaatacacagtagatgtggaaggacacggttgtacatttatccaggccacccttaagtacaatgttctcctacctaagaaggcatctggattttctctttccttggaaatagtaaagaactactcttcgactgcttttgacctcacagtgaccctcaaatacactggaattcgcaataaatccagtatggtggttatagatgtaaaaatgctatcaggatttactccaaccatgtcatccattgaagagttgctacctgtgtttatgaaaacatcacggcaccaaggaatgttccataaaacagaacgtgacgtagaaaagagtggacattgagttctgcatgggctatggtttcttgtcaagtcttatttccttatcatcccattaaatgttgtcattttgcaaaaaaaacaatgac

SEQ ID NO: 261089 - DNA, 467 bp, Homo sapiens
gaatagggtacactttttttcttaactacttgtatatctctttctctctttctttctctctttctctccttgactccctctttatctctctgtcccttcctctccctctttgtctctttttctctctctctctgctggtctttccttgcctctgccagctgcttatgctgctgttctctcaaccactgtggcatggggtggatctaaaaccagcataaccaagtgtccatgtatgagaactgttctgggtgccctggcttataggttaccttgtgccatacctttgaaacaagggacctgtccaggcttccttctgatggccaacccacctctaatgctggccaatccatttcacacaaagttctaagttttcctggtgtcatagtaacaccgtaaggggacctttcctgaaatttttcaacatagttcctagttgggtgggcttactttgtgcctgacccatgtgt

SEQ ID NO: 261090 - DNA, 450 bp, Homo sapiens
atgtctaagtcagccatagaacctagcattgccctcatatttaagttgaggcagtcatctactagcaggtattaaagaaacattacttaagacacttgttaaggatggtaggaaggcttttctcaagaggagttactgcagtgagggttttgcagtgtggaggatagagatcaagctccactgtaaatacaagaaggacaaatgtgatgtttagctgagtgaaatgggagttagtggatggaaaattcctcagaggaaacatcaaagctagggggactcttgctagaccaactgtttttttttttgaaaaaccactttattgaggcatgattgacatgaaaaaagctgtacatatataatgtatgtaactcaatgagtttggggatgaatatacagccatggggctgtcaccatcatcaaggtcataaacatatccatcacctcccaaag

SEQ ID NO: 261091 - DNA, 859 bp, Homo sapiens
tgtttgtgagacagagtctcgctctgttgcccaggctggggtgcagtggtgcaagctcggctctctgcaagctctgtctcctgggttcacgccattctcctgcctcagcctcccaagtagctgggattactactctactgaacccatgaggcagaaatttgagaccatcctgcccaacgtggtgaaaacatggtgaaaccctgtctctactaaaaatacaaaaattagctgggcgtggtggcaggtgcctgtaatcccagctactcaggagactgaggcaggagaattgcttgaacccaggaggtggaggttgcagtgagccaagatcaagattgcgccattgcactccagcctgggcgacaagaacaaaactctgtctcaaaaaaaaaaaaaaaaaaagtctgtactgataaaacccattgtgtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcacaattttaagtctaggaaataaagtattatatatactttcaaacaagctagcaaggcttttattattacttttttatttgaaatatcttatatatttggttagttctgtttaacttgtttttaactgttgcccttatgagttattttatataaatttttacaataaaataatttgattttcaaaaaaaataaaa

SEQ ID NO: 261092 - DNA, 388 bp, Homo sapiens
  misc_feature (36)..(36): n is a, c, g, or t
  misc_feature (39)..(39): n is a, c, g, or t
  misc_feature (42)..(43): n is a, c, g, or t
cccgggacccctctttgccctctttcggaattgggntcnggnncccccccccggtgaatttgcaaaactctgtctcaaaaaaaaaaaaaaaaaaagtctgtactgataaaacccattgtgtacaaaactttgtatgtaaggaagattttaattttctctttatacaagctgagtcatatttaaataatttgatgttggcttagataatttcagatagattttatattctggatttgtgtttttgttaacaaatatacaaagactttggtgatcactttgcaaatatttgttaatccttgagtttgagaacctgtcttttaaaaataatattttgtatactaattaagtgtaatggaaatcaccgtgaatctacctgggcgagtcctct

SEQ ID NO: 261093 - DNA, 474 bp, Homo sapiens
cctttgccctagctttgcttgggtccgctgggttcgttctgcccactcagcctggcaggctgcactcagcccacgctaccggcctggatcccatgcctccaagggagactgcaagtcagagttggccatgcccagttaaataccagcatacaaggaaacctcacctcgttgggagaatatttcacacccctccaaactatcagcacagtggaaacttggcatgtcccacattaaatctggctgcagctgtctcagggatccaagactgaatgactggtgattttacattgatgttctgctgaaccttcctggtacctgagtggttaaaatctgagaatttctagaagaaaagaaagtacgtctaaagcaatgctagaaaggagctaataaattcttcaggattaacatcaaagtctgatgcaaactaatttaatccccttgatattcagggataaattaaagctaatgaattac

SEQ ID NO: 261094 - DNA, 681 bp, Homo sapiens
agacccaggctctttctggcttattgtaattcatttccttagcatgttgggttttatcttcattctgttcccttcacagttgtggaattcctgttgcagcttcattttttaaggacacaaggcaggaaaggggaagggcaactccacacgtgtctgtcttcttatcttgaattgcaaagctgtcccagtaccttaccacctacttgcttctctagcagattctcttccatattatttaagccactgggtcactccaggttacaaaggtagcggtatattgaaactttgaaatttcagcctccatagtaaagaagggcaagggagaaacggtgtttgtttagtcagtctaaattgtcaaaggagatagccagatatctctttttgagagataaacagacactcttcatttaaacatggtataacttggctttaaggcatatttctttaaaaatatattgtcaaggactgcgaagagcctgaagctactttgccatactttcagggctagcagaagacaggagaatatttggtcggggaaaatgaaccatttattagtcacagagggacagcattaggcaaggggtcatcacttgtgccaggtcaccaaccctcagtttctataggacagtatgggcaggagacacctgcatgtgcagtggcttgcattacagatgaatccca

SEQ ID NO: 261095 - DNA, 443 bp, Homo sapiens
gttacatttaatactcaaagatttaaagtgaaaaggatttcttgtaaaaagcagatttttcatggtgcctgcattgtcagaggcagctggagaggttggttcagatatgccctagtgagtatgtgccagcttctctagcagcctgtggctcccgagcataaatagaaacacagctgcatatgcaggctgaacaagaggaagtgtctgggcacctccctggctggagcagaaggctcccagggtgcttagctcacctgtggcatggggatggaggggccaggtagtcagggagctggtgggaggaccacacacgcacattcccccacccaaacacacacttgcctctaagggttgggggtttggcagactgggctcacagtattgactccctgtatgacctagacaagtcacttccctttctgggcctctgtcccctcatctgc

SEQ ID NO: 261096 - DNA, 333 bp, Homo sapiens
tcaaaaggcagagagccagagctctagaaacctgcaaaaattggctaagcctgcagtcttcatttctttaagttgagcatcttcaaagtctagaattctaactgtagggcacagcagctgccactgcagatctgatcctctcagcttttggcagctctcaacttgagattctagcaaaagaatttttcaagttgctattattgcctgtcatggatttataaatattgtgcactatctgctgtggcatggctctcatgggacgccagagcatgccaaatgcataacagaatgaaaaacagtttctattcttcaaataaatgctaatttttttta

SEQ ID NO: 261097 - DNA, 397 bp, Homo sapiens
tgggaggaacagagtggttgtacccatttaaaccccaccaacaatgtatagaagtagtagtgctgattttgaaagtatgtaatggaatctgagtatggttttaattgtcagttccctgatgaataatgatattgaattctttttaatttgcttgttgtctgtttaaatatctacatttatgaaaggcctacttgaatcttttgttcatttcttaaaacattgagttgtctttctcttactgatttgtagtcaagttttatatattttgggtgcaagtcatatgtcaatagttgttttacatttttcttctcctaatctgtagatcattgctcactctcttaatgatatgtttcaatgaacagaagtttttaattttaatgaagtctatttgatcaaa

SEQ ID NO: 261098 - DNA, 481 bp, Homo sapiens
cattggtcagctgcttaattgatcacaggttcatgttgttactgacaggcttcagttatgcctaatcatgagaaacatttgtgcagcctccatctcctttttgtttttaaattaattgagcaagacaattgcagattatgcagcccttagtggcgcctagacaggaacttgaagggactatcagggacaaaaagggacctgaagagaactgaagagacccgaagagacctgaaaaactagttcaggccatgatgggaagagggggtcggacatgtctcattataccctcctccctttggaattcaggcaccacttgtagctgactgtcactgctactacttgagactgtcactacagcagtttctactgttactgtctgagaccgtcattatgagactgaacgaaggcacaaacgtagaaatgataacaaaaaacaaaagtaatttttaaggaaaggctagcatggggaagaagaagagag

SEQ ID NO: 261099 - DNA, 480 bp, Homo sapiens
accctagctcggtacccatcctccctctctcacgaaggaaaaggaattcagtgaaatagagacaatgttgggaacaaaggaaaattttcaaaaagctgccactaataacttcagaaatacaagaaaatttgttgcatctttagaataacaacaggaagcttgggaaaaagaaacatcagagcaataaagagctcttggggaaaatatttttatttcatatcccagaaaataaatttaaaagtgcatacaattttggaaaataactttgttgaaaaacaagaggaataatgatgaataagaaggaaggaaagaaaattagaatctcaatctaggaagcttcacctctaaacattaggagtttcagaaagagaagatagagaaaaaggaaaggataagataatcaaatgaataatgtaggaatatctcttacagctgaaatacgtgagcttctacactgacgggttccctaattactcagca

SEQ ID NO: 261100 - DNA, 705 bp, Homo sapiens
agagatttttagacacagacatgtggagctctccatcaggaaggatggcttgccctttcattaccccgagtaaaacccagcaattaagtatctgcccatgcttacagtgcttcagatgaaacacttgatgcttcactctgaaaaaacaagcggacaatccaggataactggatattttgaggaaggctttccacatgaaagagctgaaaacacgcacaatatcaaccagccaatgaaagaaacaaatcaacaaaacaacaaggaaaaggaattcagtgaaatagagacaatgttgggaacaaaggaaaattttcaaaaagctgccactaataacttcagaaatacaagaaaatttgttgcatctttagaataacaacaggaagcttgggaaaaagaaacatcagagcaataaagagctcttggggaaaatatttttatttcatatcccagaaaataaatttaaaagtgcatacaattttggaaaataactttgttgaaaaacaagaggaataatgatgaataagaaggaaggaaagaaaattagaatctcaatctaggaagcttcacctctaaacattaggagtttcagaaagagaagatagagaaaaaggaaaggataagataatcaaatgaataatgtaggaatatctcttacagctgaaatacgtgagcttctacactgacgggttccctaattactcagca

SEQ ID NO: 261101 - DNA, 154 bp, Homo sapiens
tgaaccaaaatgactgtcttcagttaaacttattgcgaccctctgggcatgattaacaaatcaggtggaaagggaaggtggaggagtatacgggattcttttttcatgttgtgtggaatagggcactttagttgaaattgaggttcaagttagc

SEQ ID NO: 261102 - DNA, 742 bp, Homo sapiens
ccccgggctgcaggcttgcattggaattcatgaaaactaggaaagaaattactcgagcgttgatgacaatacttatatctcttaggactatgaagttggagttagattatgtaaatagccgtacttgaaaaggcttggctcattataagttctagatgagtgcttgctgttatttttattatctgaagcaacaccaagcatttgcatgttgtttatgtaaagttgcatcctctgctctgcgatgcagtggcctaaaatgcttcctctttggaggaaggattcattcagtcagtcaacgagcactaatttctgcctctgtcttgaacttctcttccagatgctcctggagggctgaaccagcacagaagttacaaggaagtgatttctaagacaccattgacatcatcctgcttcaggaataagtgagaacatgaaatgcctaggtttgaaaccgcctttcttgagtgaggactgcaaggagaaccttggatgcttttcagatgctgcctgtgtttcatggtctctgagatttgcttcctaaacaagatgaggcacctgagccataagggtgtgggatcagcttcacggaggccagcctcagccactggtgggccgatttgggacagtgacccccaatgtcagatgtccacatgatactcacagcccacccggactctgggactttctctgtgaataagctagtgagaccggaggccaagcagatggcaagctgtggccctct

SEQ ID NO: 261103 - DNA, 441 bp, Homo sapiens
agattttaaccatatcaaatattgctcaaaagacaggaaatagaactagtgatgtcttcggagggtaactgtggggctgtaccacagttggcctcccagttgaaactcactttctgtgcatcttgaagttccagaacctatcaaggaatcacagaacccttgattcctttgggctctgctcactgacactgtctagacctaagtggacagcccatcttgtggagatgatttattggagtgattatcagtttggggcgtggcagtgcagagaaagggggatgcgaggggcttgcgagggggaggggatagtttgactttacaggcttgctttggcgcctcctctccatccagtgctgtttaggtcttactgtgcttttctgctttactttttactagtttttcagaccattaatgatagcttatgatggctgcttttcttag

SEQ ID NO: 261104 - DNA, 566 bp, Homo sapiens
ctgctgtagcatctttgctcccactgtgacagtaaactccttgagactggtggccatcttgggaagtgattagattcagaagaggttgagaggttggggcccccatgatgggattagtgtccttttaagaaaaagaagagactggagctcccactctcttcaccacgtgaggatatggcaagaaggcagctgtctgccaggcaggaagagggccctcaccaggaactgaatctgctggttccctaacctcagatttccagggtccagaattgtgagaaagaaatgtctgttgttaaccaatccatctgtggtgttttgttatggcagcacaagctgactaaacaagtgccaaaaccaaaccagtaactcccactttctagtctcggacccagtattaaggaattctggtcacatagtttattcatccatttaacaaatatttagtaagtgcttctgtgccaggcatttttctaggcctggtgatcatttaatcaaaagagactaacacctgctccctgatgcttacaatctgaaagacaataaagaaaaatatagtaacagtagtg

SEQ ID NO: 261105 - DNA, 706 bp, Homo sapiens
gttgagtactttttctgtactaggctctggaaatatagttgtgaacacaacaggaatattctgtacctttatggagcttactgaagtgtagaataagcagataaaagtataaataaaataattacacagaagatacagttacatttatcataagagctatgaggaagtgatacagtattctacgagagcatataactgatccgcagggttgtggaaggcaactgaaggaaatgactttcagactttaatttgaagagtaaatagataaagatgacatggcaaaaggctgtgaggagggaggtagggtcataaagagagcattttaagcagatggaataaagatgtgatgaaaaataagatgaaaattatttggtatttttgaggaattaaaaatatctggcacatttggaatagtgagaggctgtggaatggaagatatggatataaaactctttagaaatgagaatatgcatcaggcattgcaagtcattttaaagattttttaaatttatcctaagagcaatgggtaactactaaatagtttgagaaagtgggagtgtaaggtattatatataagaattgtaactgcattattaaagattctatgaccaagaatacagggaactaggggctgggaggaagtgatgtagtgttctaaacaagagacactagtggcttggataagagtgatcagagggagaggtaa

SEQ ID NO: 261106 - DNA, 235 bp, Homo sapiens
  misc_feature (1)..(2): n is a, c, g, or t
  misc_feature (180)..(180): n is a, c, g, or t
nnttcattattaattataccaatcctttcatatatgtagaaaaaatgtttgagttggtcatctgtcttttattgaagatgcatttcaaatatcaaatatatttgaaagataaaatagcatctgtgaaattgaatattattttatgtgcgcttggctatgccctaaaatgtcagtttattntccctaaagacgtatttattgatgtttaccaagaatagaagttggctgggcacaa

SEQ ID NO: 261107 - DNA, 594 bp, Homo sapiens
cctcaagcttccctcacatatcttctgctctgagcactttgtctagagcagaccccactgcttccatagctctgcttctctggctttataacactcatcactttcagaaagtacctttttaattgaattttatttttaaacttatttattctctatctcctttaatggattgtcagcttcagagggcagggacttggttttgttctctgccatatccccagatcctggaagagtgcctggcacatacctggggcttgacaaacatttgttgaataaatggacggaagcctgggcctttccagggccccactgcttttccagagggtagcctgtgaggtatcacacctagctccttccctcccacaaccagtgctggcccgggcccagcatctgccagccccagggctcccttgaagtgacctgctcactgaccgccaggccccgccatggataacacatacatgcttgtgcaccgtgagaagcaccctgaaggggcaaggagggagaagaggagggtccgagggctatgggatgatggtcagtggtccctgctgtgcacagagctgtaccaacagccaggtgattctcctccca

SEQ ID NO: 261108 - DNA, 262 bp, Homo sapiens
gccatttattctttagaaagcccctttgtttgatgaaaccctggtgtcacaggctgtgtgacttagggtaatccccttgtccacatctgtgaagtgagattacctcttcacctcacaggcagatcaaacaggaaaacaaaaacaaaaccaaacccaaaatacacgtaaattgcagagtgcttgaggtttcttttaagctgtctatgtaattaaaagctgttacttagacttggatatgaaataaaatctgacttcaaattta

SEQ ID NO: 261109 - DNA, 484 bp, Homo sapiens
tctccatccctccatctccaacctgggtccctggtgcccactgcccccaccccagagatgagtcgccagtgccatgccctgcaggaggatatgcaaacccgcagcaagcagctggaggaagaagtcaaaggccttcgggggcagctagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactcaatagagc

SEQ ID NO: 261110 - DNA, 374 bp, Homo sapiens
gtcaccatcctgctctctttcatcctgcctgcccccagaggcatgccaaagggaggctgcagctgcccgggaagaggctgaacaagctctcggagagcgggaccaggccctggctcagcttcgggcccacatggcagacatggaggcgaagtatgaggaaatcttacacgacagtctggacaggctcttggccaagctgagagccatcaagcagcagtgggatggggcagcactgagacttcacgccaggcacaaggagcagcaacgccagtttggactcaccccccctggatctttgaggccaccagcccctagtctctagtgttctctgaggccccagcaataaagtgtcttgatgtagaactcaatagagc

SEQ ID NO: 261111 - DNA, 475 bp, Homo sapiens
gctttcctatcagaccagtgtctcaggctggccagtggtgcccctgagcattccttcggttcaagagtgaaactcaaggccacagcagctctgaatctgccctctgggacagcacaggccctgagggctggggccatcgtagctctcctgacccacctgagatgctaaagctctgtgtgcttcatcacagccctgcatggtaaaattgggtccacaaggcaaagaagctgagagaatgggttctttttgtttgttttgagacaaggtcttgctctgtttcccaggctgcagtgcagtggtgcaaacacagcttattgcagcctcaatctcccaggctcaagtgatcctcccacctcggcctcccaagtagctgggactgcaggtgtgcaccaccacagccagctactttttaaattttttatttttgtacagacagggtctcactatgttgcccaggctggtcttgaactcctgg

SEQ ID NO: 261112 - DNA, 477 bp, Homo sapiens
gtgtcgtccccagtgtgggaagaacctgtttttgtttgcctgtgtgttcagtatagatcatcagtatgtggggtcagccggcttggtttctgcaggctccatggaatcttctagataccttttcaccatgagtctgaacgtttttctggaaagtgcccctttgaagtgcatttttctcataaatctgaagtgttcacagatgcagtttccaaaagcagtgtacatcctgccgttttgcccaaaatgcttcctcagatacagctcctgagagatagagctcgatcttcagagaacaatgaagtctcgaaaggtggccagagaaacctctaaacataaaacagaagcatgctgctcgttggggtacagcaagccactccccccatcagacagtagtcattagatcagacttaattaaaatcacagagaccacgcagtgagatatttggaaataaaaaaaaaattggaaagtctgagaca

SEQ ID NO: 261113 - DNA, 428 bp, Homo sapiens
aagttggctctagcgcagttttttttcttgtcttaaagcatttaacgcccctgtacacaactcactccttttaaagaaaaaaattgaaatgtaaggctgtgtaagatttgtttttaaactgtacagtgtcgttttttgtatggttaatacactaccaaatgtgtctttagatggccctgtcctggtggtattttcaatagtcactaaccttgcctggtagagtatgggggttgtaaattggcatggaaatttaaagcaggttcttgttggtgcgcagcacaaattagttatatatggggatggtagttttttcatcttcagttgtctctgatgcagcttatacgaaataattgttctgttaactgaataccactctgtaattgcaaaaaaaaaaagttgcagctgttttgttgacattctgaatgctt

SEQ ID NO: 261114 - DNA, 653 bp, Homo sapiens
tacaaacttagtggcttaaaagaacaagtctataaatcagaaatccattacaaatcttacaaggctaaaaccaagatgtctggagaactgtgttccttactggaagctctagggaagaatctgttctcatgctttaaaaggacatacatgttccttggttcatgggcctattcctccgtcttcaaagtctgaaacagaagttaagtacttatcatgtctcattactcacctctccttttttctccctcttctacttctaagctcacttgtaattactttgtgcccacttggataattcaggggtagctacccattttaaagtcagctggttagtaaccttaatttcatctgcaacctcgatttccttcttcaatgtaccctaacgtatctaccagttttgaaaattaggatatgtgcatctttgagggggtcattattcttcctatcacaagtatgttttaatctttttctaaagttttttttttttcaaaaatagatgaaacactaaagtgtttgctacctatttcagtatttattactctaaatgtcaagacagttataaatgcctaactcagtaacgtcccttttcactaaaaaataattcatcttatttgactctccttgaatatgctgatgtgaatgtcagcaattct

SEQ ID NO: 261115 - DNA, 390 bp, Homo sapiens
ataaaaaattttaaagattttaaaatttcttgtatatccagagacaaatggaaaaagaacacaattagaaatagacatttacctgttttatatcccctagaaagtgatacataggaaaaaaggtgaagaaaataagagtcacttttaaaactaaatgtcctcaaaaagccagaatgtattatatatcaggatgtaattttcttgaaatattttcaataactttctattcttaatggaacagaatgtgtaaataaatgtgtattgaaaatggacttttggctgggcacagtggctcatgcctctaatcccttgagaggccgaggcaggcagatcacttgagcccaagagttcaagaccagcctgggtaacatgacaaaacctcatctctcc

SEQ ID NO: 261116 - DNA, 260 bp, Homo sapiens
actacttattcacaaaagttcaagggcaagtgttttcatctggacttcaatattacgaactacacaatgggaaacttgctctaaagaaaaattgctggattaagggatgtgaatattttagcagtgcttgacacttagccaaattgccttccagaagtgatgaaacaacttaccctcccacaggcagctcatgaaacctcctgtctcaccaaactaggtattggaattctaaaaagaaaataaagctgtttgccaatttg

SEQ ID NO: 261117 - DNA, 431 bp, Homo sapiens
tgacattttggttactttttgttctataattaatcaaactaatcatattttaaatttgggagaaagaatgaaaggacatgtctgtttcctgatttgtctgattgttcagacaggcctgatattgaaagcttttgatactgagatcctattaatctcagatgatgatgaagttactgtattcttaaagaaacaaagaatttaaatagaaattaaatgttatttgtaattacaaatattagtcttttgtaatttatgaaacttcaaacatgaaaaaattagatcatgaattagtttctgtaagttatagaaaaaaatacaatgaagttaattaaaatcatcaaattgtatcattgtgtatatatctttctattcctgtaacgtttatttttattcctttttataataaagccaatttttttcttgtgaaaaat

SEQ ID NO: 261118 - DNA, 556 bp, Homo sapiens
tccagtatggaaatccatctgttccagcaccatttgttgaaaagactttctttctattctcaatattatatttgggagtgaaaaaaaaaacaaaagaaaactttgcataatacaaggttcacataaaacccaattcttggctggtgggaggatcacaagaagattatcagagacacaggatgggggttaacagagtgtgtgtctaaaaggctgagaaatgctgcctcaaagccctctggccccgggcccggctgcaggtatgcatgttgtggtcccagcttaagataagcttgcggcagggcgccaggctggccctgtgacctagggctctgaagacgccagcaaaggcccagcatggaggctcattcctgtaatcccagtgctttgggaggccaaggcaggaggaactcttgaggccaggagtttaagactagtcttggcaccatagtgagaccccatccctacaaaaaaattaaaaaacattagccagatgtggtggtgctcacctgtagtcccagctacgtgggagcctgaggtgggaggatcgcttgagtga

SEQ ID NO: 261119 - DNA, 471 bp, Homo sapiens
tagaatcatagactcatgattctatttacttcatataaagtaaactgaactgatatttgagaaaggttcaatagataaaggatagtctctttaacagaaggtgctcaaaaattggatatccacatgcaaaaaaatgaacttccatccataccttggatcatatataaaaactaaaccaaaatgaatcccagacctaaatataaaacctgaaattattatccttctagaagaaaacataggcgttaatctttcttatttacacaaagatttcctaaatatgacaccaaaagcataattcataaaattaattgataaattggatttcatcaaagttagaaatatatcctcatcaaaaggcattgttaggataataaaaagacatgctgatcccaggagaaaataattgcaaaacacatgtataataaggatttttattcagaatgtgtaaataattctcaaaactcaataata

SEQ ID NO: 261120 - DNA, 490 bp, Homo sapiens
aagagcctctgctgaaactcaagagcttctattaaaataaggtatattaaaatttttgaacttagcagaatgaaagacgttagaagtccaaatggtaatactgtaattgtagacggtcactttttaaaaaagtattgtagagcctgttctgtgttttaaattgaaccttagattttcatgattcttattctaaaaaaattattcttaaaatcaatcttgactgaaattatattctgccaaatttgagggaactacttatagtaatttccccaagttattcttaacatagaaaattgtcacatcagcatttgtgtggatgaacacatataaaatgcagaatttgctatgaagtagaacaaatatttatgaaacatatagctgaatgtttttggagagagttatttcttctcatggacatggcacattatttaaaaaaatcagaaaatactgtataatctagttgagtgaacatgaggactgtttttagatg

SEQ ID NO: 261121 - DNA, 409 bp, Homo sapiens
acgtctggagttagcagcaaattggaaatgtcttgggaagcttgcatagtctttcagatagtcttaaagttgacagttgcctggagttgtaaacgttttgaccacatttcaggatatccactacttttctgggtagaaaactaagttttgtcattgtacccagagttcacagagatcacaaaagttaagatatgtaaaacagtatatcagtgtatagaacttcagtttggacagtgtcagaatatatgtctgtccattgattggactactgggtgtattataaggctacttcttgtatctgagaatctgaattattaattaggagatttttgagcatagaggacagagtaaaattaaggataaagttaaaggtttcttttctatataacactatttcatttttcttttt

SEQ ID NO: 261122 - DNA, 387 bp, Homo sapiens
cacagccaagacttcccctgcattgcttggggatttgccaatcccgttgctagggatttcttggcctacctgggttggaactatgcttccaatgattcccttcactgcatagttttgtgttagcatggaccacgagaggcatttacaggagacttgaaaggcagaagtgaagcagagaccattttcctttcactctcagagagcctctgcaagacagcaggtgctgttgctgtctctctgtctgcccacctcacccatgtgaggcagcagccaggtgggctgcctctccagctccttctggctttcgcccttcggctgggacaggagcaccctaagctgtgtgatggaggaaacaagcttctcctgcaatgaaagcttaaaggtggt

SEQ ID NO: 261123 - DNA, 414 bp, Homo sapiens
cctcacttctcctgtagctcccaggaactgtcatcatgaaccatctgcaccctcaccatcccttaggggctgggcagtgctggggctattattctccttgaccttgagaaaacagaggacgccgggtggcctggccagggtccctcggatgtaagaggaggattaacaggaagaagttgagcatgtcctatgtcccaggcatatgtggtctaagtcttcacatacacgacctcacctgctcactaccacaggctgcagaggaggagctgagctcccatgttaaggtgaggctcggaggcattaggtgaagtgtccagttccccagctcttatgtgaccagctgggcgttcagcggagatatttctacctctctagcttcccatcctcaagaatgtggctgggccagacctggac

SEQ ID NO: 261124 - DNA, 461 bp, Homo sapiens
tttcaaagtgtgatgagtgctatgcagaacatgaaacaaggtgctgtgataaaagggactggaagggaggtgacagtcacttcagagggctgaggggacagaaagcctttctgaggaaatggcatttgtgttaagacctaatactgggactgtgtgagtcatatgaaagtgtggagtgggggtaggggagtgttacaggtagaggaaaccgtgagtgcaaaggccttgaggcaggaatgagcttggcttgtgaccagggagtgacgtctaggaagagaggtcagcaggggccaagctaggcagctccttgaagcccccagttagtagctggcttttattctgagaggatgaggagccatgacagagggtccaatgatagaatccaggggctggcaaactatagcccacaggtcatgttggcccacctactgtttgtgtaaataaagttttattggaacaca

SEQ ID NO: 261125 - DNA, 522 bp, Homo sapiens
aatgggctcggggagtgggcctattcagcgccggatctcttgggggcatggtcctggggctcctgtgccgtgtatgacagcgggggctacgtcaaggagctgggcctgagcctggaggagagccgcgaccggctgcgcttcctgcagctgcacactggctggcaacaggagccgcgctgtgttcctggagccccccgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacc

SEQ ID NO: 261126 - DNA, 260 bp, Homo sapiens
tttttttagagaactagtgatacagtattgtcatagcaagtagtgacaattatccaaatatccctagaaatcttatttggcttcagataggctaagaaatttacttgtcctcctgatgacttgaactcacaggaggcggatgggctacaggcggaacagacacgctagataaaattcttaccgacgtggtacaaaatgataggaatttgggggtgattgatctttcatttattcattcagaaaaaaatgagtacattcct

SEQ ID NO: 261127 - DNA, 372 bp, Homo sapiens
ggattaagggtggtgcaagatgtgctttgttaaacagatgcttgaaggcagcatgctcgttaagagtcatcaccactctctaatctcaagtacccagggacacaaacactgtggaaggccgcagggtcctctgcctaggaaaaccagagacctttgttcacttgtttatctgctgaccttccctccactattgtcctgtgaccctgccaaatccccctctgcgagaaacacccaagaatgatcaatttaaaaaaaaaaaaaaaaaagagcaaaagacttaaacagatacttcacaaaataagatctcaaaatacccccaaaatgtgaagaaaaccctagaattgctaaaataaaaaagtactaacaatacca

SEQ ID NO: 261128 - DNA, 427 bp, Homo sapiens
tccttccctggcctctggaattttctctcaagtatgcaacgatcagggttcagctgaatatttgagtggcagctctcccaggactctctgagctttggctgcctcggtttccctggactcttgcttagtctcctcatggagttgtctggagactctcaagccagtgagtgggggcagttataggctcacctcagttgttcccaactctgtgtcatttgtccttagttgtctgatgtccagtggcttgaaacttgttgatacgttttgccagttttttggttgtttcagcaggaaggtgaatctggttcctgttactatatcttgcctggaaacagaagtccctcatatatatgcgtttagtcaaataggtgcacttttaggcccaccaaataataccagactagtagcttttgtaggtctctctcca

SEQ ID NO: 261129 - DNA, 721 bp, Homo sapiens
gaaggatctatgagacgtttgaaccgacacattttagagaatttcctttaaatgatgagggtattgaaggaaatgagggtaaattctattagaatgtagccaatatctggaattggccaggaagtaaagatatcccaattttgtttggatggtagagatggcttatagaaagtggtcattgctaggttactaaatttgttatattccagaaaaatcaaaggagaaagaaagacatcaaataccacacaaatataaaatgacagctgcccatgagcttttgaaacactaaagacaaatttagttgagtttctggatttcagttttgaagtttctgttggcccaacatgttctcaaaaggatgtagcctttactggatctgattaggcattatatgcataagatgtaacatcttggatttctactggaattattaccacctgaagaatttcaaagtcctagctataagaacaatctgaattatggattaaattttttctttggcatatattcagggtcttctgtatagagatgaatttgtggtcataattgtgacaatattataaaataatattgatttctgcaaggtcaagtgcagcagacatcaaggcttactagctgtcttgctctaaaactttctataagaaagcaatctcatgtagagacaacaccagggattttagaaagagctatgatttggattctagaaagcatgctttcaatg

SEQ ID NO: 261130 - DNA, 415 bp, Homo sapiens
agctaactctactcttgactcctggaatatgaggtccaattcaaatccaggctccacattgcaggttttgtggataaatgcaatagaataattctggaagcaagtaattctggtgattcagtgtattccaggactcccatgacaactctttcttaccctagaaaatgctttgcattaactctttgtacctttggtgtaaatccagtgtcacaactgtcctggccaggtccaggacattttttaaacaaatcctggtttaaatctaaatgaaaatacagaatatactgtaaagcttaataatcaacactaattcaagtgtatctggggagtgaatccttatctggactccaggcatctcccatctgaaaacttcttagtgcagagagtaataattctgtatataaaagaaattgta

SEQ ID NO: 261131 - DNA, 372 bp, Homo sapiens
agaatggaaatatctatcctatgctgattccaccattgaattctctttgatttcacatgttcagagctggagagcagtttgcctccgaataaatcataccttgagtctcactcatagctaatttagagatatttcgatgagacattagactttttagttgatgctggaatgagttaaaactttctgggctttggggatgtagtaaatgtattttacctgtgagaagaacatgagttttggaggatgattatttcataaatgtgaagctcttataatgggattagtgctgctataaaagaggccctcaccccttttgccatgtgaagacacaacctaaagacagccatctatgagccaggaaacactgtcacc

SEQ ID NO: 261132 - DNA, 643 bp, Homo sapiens
ctagagtcagggtgttggagtggagggtgtacattccatggaaggaacaaataaacagagacacagaagtcagaatgtgtagcaatttattgggaaagagcaaacatctgtttctaccccatctcatttcagaaatgtaatctgagcaatgagctgtcaggtgtgcttggaatataagcactgctagggtcatggaaagcccatcaaaatttttaaaaggagtagagtgattgtggagagttgggtataagagggaaaatttgaatttaattctgctggtgatgcgggatcatgattttgggtctccagcaccatatcagagaaaccccttatttatatttggaataagtagagaaacaggcagagcatggtggctcacacctgtaattccatcattttgggaggctgaggtgggcagattgcttgcacccaggaggtcaagatcagcctggacaacctcatgaaaccccatctctactaaaaatacaaaaattagccaggcgtattggtgcatgcccatagtcctggctgcttggaaggctgaagcaggaggatgaatggggcccaggaggtgaaggtggcagtgagcagagatcatgcctttgcatgccagccttggtggcatagccaaaccttgtttcaa

SEQ ID NO: 261133 - DNA, 409 bp, Homo sapiens
ggtcccaggttcttgtcctacgttcgagaagaatgagttatgcagccaaccagagggtgaccaaggcagagaagagttttatcaaatggcagaagagctctccacagagagggttcccaaaccgctgccttgttttgagctgccctatggagagtctcagtggcgaggaattgaggacagacttctgtacggacctgaggtcatcattccaacaacacatgaagagctgaatcctgacaacaacttcattggtaagcttggaagtggattttcccccaaacaggccttgaggtgaccacagccctggctgactgcagccttgtgaaataccctgagacagaagacccagctcagccacacctgaactcctgacccacagaacctgctataataaatgttgttttggcta

SEQ ID NO: 261134 - DNA, 417 bp, Homo sapiens
aagaaagtatattttcagaaatgtagatttgttatttaaaaataaaaagcagaaattttgacaaaagatattcttgaagacgaactggccatactgttcaaaactgtgtggtcgtggttttgaatatgaatgcaatttcttatgtataaaaatagttatttcatgaagaattgtacttcagtggaaaatataattgagagattacaatttttaaaaaatcatttactgctattgaaggtactggtaagtttctttaatagttttacaaattccatcccacttagtactatggcaatataaaattctatctagcacataaattctaatttaataaatcaacaaagtattgttatgttttactgtggttactaacaaccttaaggtctgtggccatcaaggcaaaacagtctccaatca

SEQ ID NO: 261135 - DNA, 296 bp, Homo sapiens
ggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaataggtaattttttaatggcttttggctaaatttacatttatcctctcactaggcagtctcattcctaagtgtatagt

SEQ ID NO: 261136 - DNA, 478 bp, Homo sapiens
tagggcagatccccggagtatccctttccctagtacatgccctgtaacaataaatctttctggatttttttaagatcttcctgtactgacaaaaggaaaacgtaattatggaatggccacagtatgccacgtggcaagactccaggtttgcacaggagagtggcccctggaagggggtcagtctcactgtcatccatcagtgtccccgtttgtaatggtcctgctctctgtcctggcatctcaggataatgatgactcaggaaaatacctccgttacattgtgggtggcagcatccggcagtgattttttaatgtttgggaatttgagcttcccctgcctgtgaagtagatacactgagatggccacccctttccaaccctgtcaagaaaacaggaagcctctcatgaatttgaccaaggagctacattcgttctctaaaaattcaaactgtattctacattttttaatccattttta

SEQ ID NO: 261137 - DNA, 706 bp, Homo sapiens
cgtatctgttgtcagtcacttcctgttctcctctccctgaaccaccccgaccccccaccccaccacagcaaccaccattctacccggtctctaggaaattaagcggtctaggtgtatcatagaagtagaatcatacagtatttgtctgtgttcgtgtctttttttttttttttttttgagacacggtctctgtcgcccaagctggagtgcagcggcgccatcgtggctcgctgcagccccaatctcccaggctcaagtgatccttatacctcagcttcctgtgcagctgggaccacaggtggggccaccactctcggctaatttttttttaattattatttttagtagagacggggtcgcactatgttgcccagactggtctcgaactactgagctcaagtgatcctcctgctttggccttccaaagtgctgggattacagatgtgagccaccgcacccagcatatgttcacgtcttaatcctccacagggccttgtgactagtgactgagcaaaaagagcaaatgaagaggcaaagaatgctaccaccatgcctgagacttcctgagacaggcacagtcccctgcctcacccagctccaaaactcctagaattcattcattcccttatgatgggcagacagcattgtagatgtggagaccccacagtgaacagaacagactgcagtccctgcctttatggagctc

SEQ ID NO: 261138 - DNA, 423 bp, Homo sapiens
gttctggaatcggttacacttagtactgagtcaccaaaggagaccataggtaaaaatgttccccaatgggaagtcaagcatatgtgcttttccatctcattgcaaagtcatctctggatgtcctcatgctttgtgacatttcatagccacttgctcctcacagcttgtctgtgctcatccagtgggtcttgaatgtcattgtatacagcacattgtgttcacatctgctgtattgctatgcaagtttcataatttccttattctcactcgaaacgaaaattttaaccttttctgattgctctttcaatatgaatatgtacaacctacttttcattttcatatcacttttaggattcatcccgtgcttttgctctccaagtactcattctatgtgtgtttctaactggaattcttatacgaaaa

SEQ ID NO: 261139 - DNA, 636 bp, Homo sapiens
agtaagaagtcaacaggaaatgcctaaagatggagaactcaggtagaatatttgaaaaaataaaaattgatagagtacctggtgtatttgaatatagactagagagctttcattttccacagagcatggggataaattagtgatctgcaaatttttcttttgttaagaaaacaaaactgaggtaattatgaaccccaggaaaaataaaaattcaaaaactacactgtatatctgaactgtgaacaatactagccatataaagttagtcataattatgtaattactgaatattgattttataagaaataattctataacattgggaggatgggagagaagagagattgtgtaatggcggcaagccaatcaaggtctgttgtagaaaagtccagaaaaagcagtatacacatgtcttttcagaacaaaacaaaacaaaacaaaacaaaaactacaataagaaactgctaagggttaaaagtgattgtctctggaaaaatgaaatcggggtgggtagagaaaaggcaaaggtttgctggttttcactaccaatccagcagcattatttgatttctttttaactatgtatatgtttttctttgattaaaaactaatataaataaacatcatttttaaaag

SEQ ID NO: 261140 - DNA, 697 bp, Homo sapiens
agaacaaacttgagatcaaattgctattggaaagattttagaaatgtaatctagaaactatgttttttcacttatatcacagttgtgtattcagaacaggcgatatctttcctttagatattctttctttcctagggtcacatatgataaaaatctaggagagtaataaagttaagtaaaacaaagaactacagttgtgttgaatgcttcttcttctaggcctgatttgaaatgtttgacaaagatgtagaggtagcctctcattgcagtattatttgaccttagttgaacatactttcttttctttgtgagttctctttaatgaattcacctttctaattagaaatgccactgtctcactgtcccttgctttattaaacttttacatcttcaaacgccttcctctgagactaatcattaattaactaatggatctttgtttcataaagactttaaagagatcatagaggaccagacggatgcatgtactttggaaaaatatttgtttaaagtctttaatatgtactaacagcttttggttcataataaatgctctttcattaatagctagcagaaagaagaaatgaaatagtactagaaaaaaccctatagaaagatgatcttgagttgagaataaattcttctgaaaaccaggaaagtataaggcagtttaatttaaaaatctggttttcaccaa

SEQ ID NO: 261141 - DNA, 435 bp, Homo sapiens
cacggttcatccgtgtcatagcaagtatttcattcttgtaatggctgaatagtatgtcagcataagaatacaccacatttatcttattcatgagctgatggacatagactttttggctatcattataaatcatgccgctgtgaacattcatgtacaagttcttatgtatgtatgttttgaattcttttgggtgtgtacctaagagtggaattgctggaacatataccactttgtgtttaaacttttgaggaacttctagactgctttccaaagcagtcgcagtattttacatttccatcagcagtgtatgagagctctaatttatccacttcatgccaacaattgttattatctccttttttcatcatagttcttctagcaggtgtgatttgatcctggttttgatttgcatttccctgatggctaatgatgctt

SEQ ID NO: 261142 - DNA, 297 bp, Homo sapiens
gcctgtggatgaggctgccccagcctgcaagtgtggccgaggacggtgaacggcaggacaggcgagcgtggggtgtgtggcacagccaggatgggtgagtgtgagcagcctcaaccgcccgtcctcagaaccgtgcatcccacaggttgtggggactcggaccctacacaggcagtgaggacaccagagccggcccctcttcattgctagtgttgctggtatggttgttaccaattcctatcttttcttggaaatttgaaagaaacaagtttattaaaaatgataaacagaatatct

SEQ ID NO: 261143 - DNA, 423 bp, Homo sapiens
gagccaagattgccccactgcactccagcctgggtgacagagtgagaccctgcctcaaaaaaaagatagaagtttgaattgaaaagctgccttctaaatagcttgaaaggaattaattgcttgaagcagagaggaaacatggtcatgagaaagctttatgatgggtgattcttgtgttccagctatgcctatgatgatcattttctaagacctttctttcctatccatctaatcttagatattactgccttctcccaagataccatcatttcaaatttgttatttcaagatgcatgttctgtccctaagaaagcagcaaatcttggccaggcacagtggctcacacctgtaatcccagtactttgggaggccgaggtaggcagattacttgaggtcaggagttcgagaccagcctggccaaca

SEQ ID NO: 261144 - DNA, 451 bp, Homo sapiens
taaaatgaattgggtggttagcgtaaatcgaatttaccgtaaatgctgtagtattgtaatgtagtattgaaaatttgagcaccggttttagagtttgaaaggcgtatcctgaggcttaatccaagaaaccctgttacattcagttaagtataacttgcttaagtgtgcaagtttttcttgtgcccccaatgaaattttataatcttaggaatgtaatgctccttatttgcatttgattcttcccttttgcttcccactccttttccccaccctcctttggcaggtacagattcttttctgatttctccaagctttgtttctacagccaggctttctttttttctctcctctttaagtgattgggaatctcctggaatattcctctctgttctgggaaagtttgtggtagctcttctttgtacattgaatttatagaaaatgtggtaacagt

SEQ ID NO: 261145 - DNA, 580 bp, Homo sapiens
agctctgtgtctgaaaccagaaatagtgaatggaaggctgtctgtggataaggatcagtatgttgagtctgaaaatgttaccattgaatgtgattctggctatggtgtggttggtctcaaaagtatcacttgctcagagaagagaacctggtacccagaagtgcccaggtgtgagtgggaggcacctgaaggttgtgagcaagtgctcacaggcagaaaactcatgcagtgtctcccaagcccagaggatgtgaaagtggccctggaggtgtataagctgtctctggagataaaacaacttgaaaaagagagagacaaattgatgaacacccatcagaaattttctgaaaaagaggaaatgaaggacttatttttcccttcaaatcaacatacagaatcttcactcatccaccctactcttccttgagcaccatcactctcataagggtctgggctaggagaactttcttattactgccagagaaaaatgtgtaattattggtaatctagccttttgtagctcaaatgtccagtttcctggacttgaagtgctggttaattaaataattatttaccaaaa

SEQ ID NO: 261146 - DNA, 556 bp, Homo sapiens
cagccaggccccagagcctctcctggcgggcatcctgaatgccagaagcttaggcacaacttcagggaagaaaacattttggaaatgacgagaaaactgtgagggagttgcaactgtaaacagcaaatgtgctaaagaccagagacttatgcagagctaaaagagggcaggtggagctgttctcagttttttacatgtgaagaaaacattgggctgactccattctggttccgcagagctaaaatgtgccttgatgactgttgttgttttatttaacacaagcacccggggctgcgtgaggatcagggcttgatgagccaaaggattctgagaaaaaaggtgaacagctgtggttcttgtcaaacacaaactcttaatcgttgcttaatcattcccccatattagacatttgtgttattttaattgttttgctatcgcaaatagcattgtaatgaaaacctttgggcacctaacttattcttttgcattatttcctttacataatttcctgagagtgggattactgattaaagcgtatgaacattttagtctcttg

SEQ ID NO: 261147 - DNA, 428 bp, Homo sapiens
agcgtacacacacacacacacaccacagtagcttaatttaatttcctaaattaaatcctccagagcagaccccagatcttgagctttacttcaactcatcctcctgcccagtacatcgatctgcatattgtcaatgcagatgatagacaatgtgaagcaagaggaagaaccacatacgtttaatgcttctcacctggactcacagggaattcatagtactgcagatgtggcactagccctagcactgagcttccttgtaggctagacacagcattttctaaaaactaaacatgaacttgaaattcagttgaacttccaagaactgtggtttgaagtagtaggtaaatcactgcaggacagctcttcaggccaacagagtcatctgatggagaggcagctctatctgaggtgctagcaaggacttgagg

SEQ ID NO: 261148 - DNA, 842 bp, Homo sapiens
tactttcgatttcagtaaatctctgcttttgttgcttcactctttacttgctttttttgtgcattttgtccaattctttgttcaaaacgccaagaacctggacaccctccaccagtaacacctagactgaaagcttatctaaatatatgtttgcttagaagtatcagggaccaaatctcaaaacaaaacaggcactctctggaattccccaccaggagattgtctcaagacaacaattaattcacaatccaattctatccatgatggtgcagaccagaccatcagatggcatcactcaatataagtcatccaagcgagtcacgtagaccccgcacctccttgcccttcacaccaactttccctttttaagcccttgctttcttccctgaaagttaaatcagttcccttaaggcaggagcctgttctgtttccccactgctaagctctggaataaaagtcactttctttttaccaccctcgtccttgttattcaattttgcaagcaatgagcagcttagcctgcgtttggttacagtaagaggaggaaggaggagagaaaccagtgggaagagagaagtcttagagacaccagtttggggagatgataagtttcccaaaaagaccagtgaagttccaaattatcctcagcaaaaccatgtcaacaagaaggagttggacagtgtaggtggagcatatagtcagtaggaattcaagaatggtgtttcagttgactcagaagttcctgtgggaaaaacaggatcaaatagaacagagaggcctcacaaagtaacaaggaaaaaatttccagcctgggcaacatagtgagactctgtctctacaaa

SEQ ID NO: 261149 - DNA, 185 bp, Homo sapiens
gctttatctaagagacagagcaggaatgctagcttttagattcccaaattttaattattcaggtcctgtttattcttattattagcagttagagtttagtagatttatattccaagtatgtttaatacgacatgggtttttccagtttgtaattcaatgcttgaattgcaatctttagaattata

SEQ ID NO: 261150 - DNA, 382 bp, Homo sapiens
ccacgtgacactggtatgggggtgccttttgagcatgttccttccagtcaccaaagtcagtctagtaggagcttccatctgttctctggaactttctgtaggtggctctccaggggtacttgggaggacttccctcctggacaaggaagccctggcaagggacctgggtgggggctttgagaggctgttgggatgcagggatggggcagccatgcctgtggccacccagacaacctaaccagagtccaccttaagaggcagagggatgaagccacatgtggacaaaaagatgggcaggaacagaggggagaagcggcacacctgcagccatgatgcccctgcaggaagggaaggagcggtgcagagagctggagaggcctct

SEQ ID NO: 261151 - DNA, 360 bp, Homo sapiens
aaaagcataaaaactcaattatgtaatatattaagaggtgtgactttgattatttatagaattatagtactttctaggtttgaaatataactgccaaaaaatatctacataaatgtttataaagtagaaaaatcaacatggttaagtgacaaactcttcccaatgcaaccaacagagttaatgcaataccagtcaaaatcccatcagggtgccaggtgtggtggctcacacctgtaatcccagcactttgggagaccaaggtgggcagatcacttgaggccaggagttcaagaccagccaagtgatctgctctgttgtccaggctggagtgcagtggcgtgatctcagctcactgcaacc

SEQ ID NO: 261152 - DNA, 182 bp, Homo sapiens
aaataaataaaatagaaaaaaaagtttaagatggaggtggaaagggttggaggagcttggggatggagaaaaaatgaactgtataaaattaaaattcttgtttttgtttttagaaagtaaagagggccgggcacagtggctcatgcctgtaatcccagcactttgggaagctgaggtgggcg

SEQ ID NO: 261153 - DNA, 502 bp, Homo sapiens
catcccaccccggatggggactctggggtgtgcatcagcagtttcaagaaacacagaatgaccacctgacccagcaattccactcctaggtatgtaccctaaggaactgaaaacgaaaactggtacaaaaacgtttatgtcgacattattcacaaccataagttagaaacagcccaagtgtccctgaactagtgaatggataaactaattgtggtctaaccacatggtggaacgttattcacccacaaacagaaggtagtacggacacatgctaccatacggatgaacctaaagcacacgatgctgaaagaagccagacaaaaggttgcctagagcatgattctgtgggtggaaaatgcccggaacaggcagacccaagacccagaggggatgagtatttgcctggggctgggagggagatggagagtgagtgctaatgggtttgatggtaaattttatggtctgtgtattttaccacaataaaaaagacatacccaagtga

SEQ ID NO: 261154 - DNA, 520 bp, Homo sapiens
gaagctaaatgtaaccgtatcttccaacctgagagctcatttagtaacgtttttgtaatacattggtcattttcccagtcgttaagtaccacgtctcggcggcgtgtgcttagaacagaggtctctggaggaatcactggggcgtgctcatgtgtgggtgttgtgctttcatggctgggttttaacttccggccttggttcctttggcagtgacatggagggagagggtagatgaagttgggtgtgtgaacttggaattctaaggacagtcctgcacaggcaggacagtaacacagacctggttgccatgccccacagaattcagtgggaaaacatgctcagcatttgtgggacaccagtgtcaccctctccaccactgcagtaagatcaggagcccatctcccacctgagtctcaattccaggaaagagcatcagggattcccccaagctgcaggcaagtgatgctgcccacatttgttggctgagtggggccaggtatggagggagatgagtgggcac

SEQ ID NO: 261155 - DNA, 283 bp, Homo sapiens
ccaagcttcaggagggtcttcctacatctatgtggatgttcacagctatgaattttcctctgagtgctgcttttcctgcatccctgagctgtctcgtgggtttttttgtttcatttatctccacatagtcatttctgcttttccttgtgatttcttctctcaagcttcaggagggtcttcctacatccaagcttcaggagggtcttcctacatcctctctccagccttgctggtaaaattctactcacctttcaaagactgctgaattttcccatgaattcga

SEQ ID NO: 261156 - DNA, 376 bp, Homo sapiens
aaaaccccctctttacaaaaaattaaaaaattagccaggcatggtagcatgcgcctgtaatcccagctactctggaggtgatgtgggaggatgacttgcacctgggaggcagaagttggaatgaccctgcatttttagcttgggcgacggagccagaccctgtctcattaaaaaaaaaaaaaaaaaaaaaaagagagtcatttattttaagctttctagatactgagccaggatgctgagatagtgcaggaagggatacactgtgtgttctataggtaactttgcagagccaaagcagtatgggataactacatatgaaaaaaatgattgtgatatgtccatttttagtaaataaacttctggcttttcactgaga

SEQ ID NO: 261157 - DNA, 3117 bp, Homo sapiens
agcgggctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttc

SEQ ID NO: 261158 - DNA, 2828 bp, Homo sapiens
agcgggctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatc

SEQ ID NO: 261159 - DNA, 994 bp, Homo sapiens
agcgggctcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgagggattggttgttattggtcacaggcaggatttttggaatgtcccctcgtatgtgtgataaccctaaagtggaaacatcccaaatgctcatcaaagaagaaggaacaaattgtggtatattcatgcaatagactattactcagcaataaaaggaaaaaattgctgattcaggcaacaacatggataaacttctaaaacatttatgtttggaaaggaaaaacagacacaaaagaatatatgctggatgattctcttcgttataaactccaagaacagcccaaatcatctgtggtgatagaagtcagaagtctactgggttagaggacattgttggaaatgggcatgaggggactttctggggtgatggaatgtcagaattttatttggatgggggttactagatgatcacattggcaaaatgagttaggcatatatttaggtgtcccttatcgttaattacggtcggtgaaaaaaaaaagggggggactaaaatcctcgggggcaagttcgataccagtttttaaagggccaaaggaggataagaaaaggggggtaaaggggagaaagtgctgggatgggagagcttggggagtgaccccaaaagagaaaaatttggtaaatggagtaa

SEQ ID NO: 261160 - DNA, 1090 bp, Homo sapiens
ggcccagggcggccccgtgtccatctgctacatctgtggggctgagctgggccccgggaaggagttccagctcaacgtgaaccccgccagccgcttgggcgagaaggagcccttcttccccttcctcaccgtgtacccgcctgcccctcgtgccaggcctgtggactccaccggcctggtggctacctgtgtgctctgctaccatgacctgctggcccagtggctgcagcatgaggcccgcagctcccaccacgctgtcagcgcctggtcccggcagtaccaggtggagacgttcgtgtgcttcttttgtcagcaggagaagaaacggtgtctggggctgaagtccgtgcgggtggcccggctgcccctgttcctatacaccctgcgagcaagccacagcctgttggtggatgacggacagcagctgatcatcggtgcttgcgtggagtgtgggaccctggtgtgtgcgggccaagggctcacccgccaaggacccatgagctggagctccccggtggcagcagcgacgaagatgaatcggcgctgtttccactatgatgcagctcctccatctctggcagcatctttgtcttggcacctcttttatctgaattattcacatctggacactgaggtctctgaggttcggagagggaaagtgacttgcccaaggccacacaggtgtcagctccaggggcagagtgctcccttctcagcccagctgcacacaggttttctctactccaacagtcgctttggggccatgggtctgagagatgctccttcccagtgactttctggtttcatgattgccaggtggccagagctgtgtccccgcctgcccttggcagaggacctcccagcagccccagaagtcacctccatgcagagcgcagcatctggcctgcagcctgcagagagctgggctgagcacgcttggaatacccactggaaacttctcactaagctctagctctggagctcctggcgccatctccctgtttggtgagatggttctgagcatattggccagatcttcccaggactcacatgtcataagaatttctctggatagcaggagaaacgtacc

SEQ ID NO: 261161 - DNA, 430 bp, Homo sapiens
aaaaaaatacaagattctttttgaatcagaaagagagatgacttccaacggagctgacaaacactgcaacagcaagcaatgcatggatgtgtaatgagaattcaatttccacttgggcaggcagccaccaggaggctccgagcccaggggtcagctgtagctgctagaggggcatctgacactgaagccacgacgccatcccagcacctacaggctttgctgcagatgcccacccactctcagagacagctgtttttctttacatgcacaactgcccaaatatgctctctgaaggctgtggaagacagctgatgggcaatatgctcaaaaatggttgtttctatacatttgctggggtgtggagaggtctctgaagccatcttctaattatttcccaggactgcagtgctgaggtcatacatttttatta

SEQ ID NO: 261162 - DNA, 348 bp, Homo sapiens
ctctttactgagggaaccagacccactgattggacgtattcatatttgtgctaatgatgcctttcatgtctgtgtcttgatagtttaaaaagtactttttgtatctattagtatttcagtctcagaacaaccctgtgtgctgcgcagagcagaccttattgtgctttttttaacacattttattccatattaaaaaattatttgaagcgatttgagatctacagaaaaatgacaagaatagtacaaagatctcctgcagccaccctgggtttcctcgtggccattgttggctgcgttgggccatcatcttctctctgttctagacttttcccaccaggccgcctcccc

SEQ ID NO: 261163 - DNA, 572 bp, Homo sapiens
ggttgttttcaggttttgattgttatacaaatggtctcctgaccatttgtgtacacgtcacttgcaaacagacacacgtttttgagatatgcacctgagagtaagattcctcaattttaagctttacaagataattccaatttgtttgctaagttgtttgtacaagttacatttttatgaagagtctatagcagtttcctttaatctatacgtgtcaaggtgtgtacctgacatcttaaaacttataatttttatggctgacttttgaacatgctaaaatatttctttgtagatttgatttacatttctctaattagtagtagttccagcattatttcaggtatatattgacacctttttttcctattttatgtaactccttttcctgtttttgttattttttccaaaaattatgtatgttgtccctttctttttgattttcaggtattatataatttatagggatgactttttaagtgataaatattgcaaatattttcacccgctttgtgaattgtcatttttgtctccttttatggtgtttataataaaaataattatttaatgtaata

SEQ ID NO: 261164 - DNA, 669 bp, Homo sapiens
gccactgcattacagcctaggtgacacagggagaccctgtctcaatcaatcaatcaatcaatcaatcaatcaatcagagagatccggatagtgaatgactagggaactaacattgggggaactgagggagtaatcaaatgaaaaatgtaacaaatttatgagaaggttaacagggaaaggccactgagtttcacactaagagaactgctggagaccagaacatgcaattttagcagaacagctgagagaaaactgaggatcaggaataaagtgcgtgaagacagaacagagacagagggtattcaatgagaaaaactcagagaaccaagccaggcaacgtaccattagacccaactatttacagtatcaactgttggagtactttctgtcaccagtaagatttaacccaatgaaaagaataaaatagcccatttcttttcattgatatgatgcaccatgacttactgtgtgcactgacttaatatgtacagtgatttaatgagggagtgtctctattcctgagagaatctttcataaaactgtggtttagatgaaagcttacaaggatgcaaaatgccatggtagtcaaatgtcctactaaacgtatggatatctgttcaaagccgctgctattaggcccaaagatagaaaacgtaggctgctcccctg

SEQ ID NO: 261165 - DNA, 539 bp, Homo sapiens
actgcatttgtgggaagcaaccctgccataaacaactcagttaacgcttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcattctgattcactcatttaatattattgaggagtgcgggtactaggccattagaagaacaaacaacaacaacataggctggacttgcacttgcagagttcacaggctagagaggcacacaagttaaatatagagacagctgaaagagctgacgtctgggacagaaggagccccctgctccaggagccagggagcagatgccatggggggctggcagggatagggacgtcaggcca

SEQ ID NO: 261166 - DNA, 444 bp, Homo sapiens
ttctgtgttggtgtcattttagtcccacacttcctgaactcaaaaccctctttcctaagacttgccatgaaacactcctatgaacaacggtgaccacgagtccctttcggggagagtgtcgttttgtactttgtattgtgtcccaggccctggatcctgaggggtggccttgggtctaggagagcgctcaacagggttcgcctatagaagattcttccggtgaatggacgaacttgtggccttgtccagtggtttcttttcctttttccctgtagtttccttccactgtcaacttttccccctccttcatagcagcaggtgttggcaaggacgtgcccagattagttaggcccagcctcttcttcttcctccgtccccacccaccttacctttaggactggggtggggtgatgtgtctggccacaacttccgcgaccacttttt

SEQ ID NO: 261167 - DNA, 752 bp, Homo sapiens
ttccccatctcagtctctgaacgatttgttctctgttaagtccatgcaactcaactgatttgttaccaattcccctccactaccccaaaacaagccagtgttagtgcattactaaatagtggaaatgtcaaaaattatgtagggcctgtcaacatctcagtatattagttccaaaccttaaagagagcgaatttatgtaacatgcagtccaggtgtcctgacagatgttttccacttttcaaccatcagtgacaaactgagacttgttgccttacattgttagctcccaatgcctaactagtatttattaggtcaagcaatttggcatctaccaaattgggctacatggaaaagcttacacatacagaaatctggtttcacactagtgaataaactgagtaagggcacccccttgagtgtgacagctggcatctgagagttcccaatgctccctgcctgcttggtaattgtaccagggaaaagaaccctcccaccacattctgtgaccataaaggatgcaagatagcacgactacttcgtagagcgtgttcattttacagcttttcttgctcaaatcactcaccgagggaagatgacaaccaggattaactttaaagctgttagtatgccactctggatattaaaaaaattctccaatcctagttttctgtgattggaaccttgagctttacccagaatcagttaagttgctcccaattgctgacccatagatgctggtttgtttctctgaa

SEQ ID NO: 261168 - DNA, 315 bp, Homo sapiens
cgaattctctgtttaacataaagccaatctacttttagagtttgggagtaagtgaggaaatactaggctcctaaaaatacttggataccccttttaattttaaaacttttattctggaagccaaaaaatacctgccagataacaacatttatgaaaagtaaatgtgttatataacaaaacagaacattcgatgtactctacaaaacagagtccttatgacgtgctggatgccattctaaatacataacaaatattaacttcttgatagctcatgacaatcttaggaggtaagaattgtcatcctcattctacaga

SEQ ID NO: 261169 - DNA, 390 bp, Homo sapiens
cccttttaagttgaagggacattatcatttctatctatggcatttctctgcaaattgaactcaaatatcctttgggctgactacacagagaacagaagaaagaagtggaagaaacttggactgaagattgcctccctgaaaaggttttcttcaggcagaattaggtgagaacaaatgacatcagaaagtagcatgtcagtatactgctgccagctccatatggttcagcttgttttcacaggtatttaattaattccacaaacatatattgagtatcagatgtgggatcctgttcaacacatttggggtacagtagtcaattagtctactctcatggcacatacatgctggaaggagagaaaaacaataaataaatgaacaaaagatgca

SEQ ID NO: 261170 - DNA, 188 bp, Homo sapiens
gaaggaggagaaactgagacggtccggaaagagccgaaagcggtgtccgggtgggtggcaggaggtggaaacagccgaaagaaaagcagccagggtaatgcgattaagagaatgagctgaacgggcggggctgaaggggagaataaacgactttcaggaattcgccggagagcaagagggaaaaaccg

SEQ ID NO: 261171 - DNA, 488 bp, Homo sapiens
aggacttggggacgagccagctggtggaggttgcagcgagccgatatcgtgccattgcacccagctaatttttgtgtacttttagtagagacggggtttcaccatgttggccaggctggtctcgaactcctgacctcaggtgatccacccacctcagcctcccaaagtactgggattacaggcataagccaccatgcctggccttttattctgattatataagtagtaagtggtcttattacagtagcaatattctataattaatattatataacatggttattgcaaaaacgtttaaattgagataacaaggaaattacaagaataaaaattacttctaataactttcgtatctggtaaaagtgggcattttaaatttgtgggaaaaatgaattattcaataaatttcattgggataaatgggtaggcatctggaggagaataaggtagatcctaaactcacacctacacaaaaattaattccaatg

SEQ ID NO: 261172 - DNA, 609 bp, Homo sapiens
aagagccaatgttgcaattcacacccaagggccatcagccttggaagttctctcttgcttggggaaggtcaggatttgtactactcagatctttaactgattggttcaggcatggccacataatggagggccatctgcttgattcaaagtccactgacttaaatgttagtctcactcaaaaacaccctcatagaaacatccagaataatgttgcccaaatatctgggcacctggccaatcgagttgtcacagaggaataaccaccccaaggggcaaaggtgaatgtgaagcaggagaagttgtgggacgtgtctgtgtgtggaagttttatccggtccttcactgagtgtgggccaggcctggcagtgctgagcacaaagaaggatgatcaacttcccaaaataggttgtgtctcaggaaagcataacattgctttaggttttaagatagcttgaagatcgaggtaaaaatcaaactttgtccctactttattctctctagatcaggggcccccaaccgccaggtcacggactggtaccggtccatggtctgttaggaactgcatagcaggaagtgagcggccggaagcaagcatgaccgcctgagctt

SEQ ID NO: 261173 - DNA, 475 bp, Homo sapiens
atcatttcaggagagttgtaatactatttagaagtttgctttgttttaggctacctctgtttagaaaaggatgagatgtaacaatagtgtacgtttggagctaggggatgattctactttacagatggaagcactgtaatgggtaaattctaaatgcggttgctactcctaagaattccatcgcagagtatttctggttctatacaaatattttgtgcagagtttgaattggagatgttacagacatgctatattgggtaggcctaggacatcctggtaaaggtgcagtgattgtcagtcagtgtttgaattgaagccttgatcatatcactgtagttcagtggagagagaaattgtgtggggtgtaggtaaaaaacaagacagtggagtctccacctgttgttccagtcatctttcctcttccctcttcccttattaaggaccctgcccaatggtaacagttgttgccaagaaa

SEQ ID NO: 261174 - DNA, 419 bp, Homo sapiens
taacttgcttggaccaagggctcacaactggggacatggcccaaattgcactagcatttactctgtgccaaggcaaccagcttccagagtgagacaagatgggggtctggggctatgaacatgtgaataaagtcctgagctataaaaataatgaataaataaaaaccaggaaaatatttcaagttcttatgtggcaacatctctagatctaaaatgtagcaggaggaaaataattgaagacatttgtcatgtgctacaggtgaactgtgaccacatctgacatcacctgcagcttccttataacatgcccactgggcagagaggatgagaggcaggagagcaccagtgtatttaggaccaacttttgaaatttaaccattaagttcagtccctcctactctccataaaacaggcccatg

SEQ ID NO: 261175 - DNA, 344 bp, Homo sapiens
tctagagatctttgcgcggattcctgtgttagtttgctgagaatgatggtttccagcttcatccatgtccctgcaaaggacatgaactgatccttttttatggctgcatagtattccatggtgtatatgtgccacattttccttatctagtctatcattgatgggcatttgggttagttccaagtctttgccatttctttaagaatgttgaatattggctgctctttcttctctgtgtctcttcctgtctcccctaccaatgttctccatcccttccaaatgaactttccctccaatccttccctccatagctgcttttggagaaacccaaactaagaattcca

SEQ ID NO: 261176 - DNA, 577 bp, Homo sapiens
tcccccggaacgacactgcaacagtcaagatatggaatcaacctaagggtccatgaatggatgaatggataaagaatatgtggtataggccaggcatgggggctcacacctgtaatcccaacacttcgggaggccaaggtgtgaggatcacttgaggccaggagtttgagaccagcctgggtgtcagccccagaatatttgcctttgggcaatctcaaaccactggtgcggctctgccccaggtatgagcatggcaagtgttgaaagccagggggttcgtgtccacttcccactccagcagccctcagccagttactgataggagatagtcccccacctgtctgttgggctaacttggaagtgcatggcctatgcgggctccagagttccccagcagatgaatccccagttccccacagtggtctgggcttgataaaataccctttattggctgctctttcttctctgtgtctcttcctgtctcccctaccaatgttctccatcccttccaaatgaactttccctccaatccttccctccatagctgcttttggagaaacccaaactaagaattcca

SEQ ID NO: 261177 - DNA, 241 bp, Homo sapiens
gcacccccacccccacccccactggaattgtgatgctgcacatttttattttcacaaggagccgattttgtgttaaaatgttgacaacagccacacctttccctgaagtctttcagtttatctgataacccttaaacaaaaaaatcattcttaatccatgtagctcgcataaagagactggtacccggctttcaaagaaaaaaaaagtcgttttcagttgggtccccagcatttctgtcta

SEQ ID NO: 261178 - DNA, 676 bp, Homo sapiens
ctttttgtagatctaggatttcatcccagaacaagttaagaaaaagttatatatgtatcacttccctacagcctgaaaaaattcttttatactttttgtagtacaggtctgctggagacagattatctcagtttttgtctgaaagtgtgtttcttttgcttctacttatgaagggtagtttcactgtatatagaatcccaggataacagtacagctgatcctggaacaacattgatttgaactgcccagatccccttacacacaggtttttttcaaagaaatatattggagatttttgtagatttgcaataatttgaaaaaacttgcagacaaactggttagaaatctcgaaaaaagaaaaagttatatatatcttgaatatatttaaataatagtctgttttctcacttaataccataaaacatttacaaatctattataaaaaaagttaaaattaatcaaaatttattgactttagttcatacaaacatgaactaaagatggtgccgtttgcagtcaagagaaatgtgaacaaatgtaaagatgcagtattaaactataactttataaaattaactgtaccgcacactatattactctattaatgttgtagtcacctctggttgctattccggtgagctcaggtgtgttgagtatctacttaaaatgtcacctg

SEQ ID NO: 261179 - DNA, 581 bp, Homo sapiens
attctgtttggttatgataagcctggaggagatagatttaagagaatgattttaattttagttcagttaaattaagttcaagaaccaggaaaacatttgtgccttttgtaatttcacttgtattaaattccgttagtgtacaaggctcaaacagaaagacctgacaaactgttgaaaactatttaagaacatttcttaacatccgtcttcttttcctaataagcatacatttttcttttttaaatttattttacttttagcttctgcatccaaccatccataacatacttactgcttttcttaaaaaagttttttccagtgaaattttttttctaacttagaagttttagtactaatttcttttaggaacacttgaaatttttcttaattgtttttggatgaattgtatgtgccacaataaacgttcatttattaacttaacattagcactaacgtcatgcaaagccctctgcagggtgctttggaaacagaagttaagatcacagggaaaaaagtttccactgcccttggttctttagcctataatgtttaacaaggtctttgtgatgagtattccttta

SEQ ID NO: 261180 - DNA, 273 bp, Homo sapiens
aggaaaaaagtgtcttgaaaaagcagccgtggacgtggagttaccaaatcatccgaagtggctcctggaccgggtggaggagccaggctgcagaaatgcagttcatcgcaggagttttcctgaacagagaaaagtctccacagaatagcaaaaatagcaaaaactcgaagtcaagggtcttgaggtctaaattttctgtgtgaccccagggaaatcgtttcatctttctaggtcttcacatcctcacctgaaaaataaagtgcttggctaaga

SEQ ID NO: 261181 - DNA, 929 bp, Homo sapiens
cgccatttgatttcacagaaaacggaaacgcagtgatgaagcccagcgcctggccctcgccctccctccacgtctgtctcgggggcgccctcccctcgcaggagccagggcacgcgggccttcaaccgccgaggcccccgccgcccttctggacttttatcgaggcatgtacactaatacgaaagagaatttgccatttacctgtaagattgagggcgacaacgtaagaggaatggttttaagtgacgcgtccggctccttactcccactgaagggtgaaggtgccacaggtggacctggtttggattctgatgtgaagaaaccgacttcaaaacatttgggccaatcaggaaaatgcgaaaactctgactacaaatttaatgatatctagaattattgttaatagtttaaggtgatagaggctatgttcctaagtgaagaatgaagtagtggcagttccatcagatgcttagagccagagacagtcctaagcaaacagctggaaaagaaatccggtgagaaattccaagcaataggaattttctctgaagatcacttggaagtgccccatgagaaaaaccactagcttcaaacccctgccaagcccagagaatgccttacactgaaatagatcatcataaaattaatagcccctcaaacactgcctggctcagagttggcgcttgttaaaattttgaggaagcaagcaagcaagcacatgggaggataccaaaacatggcagtaaaaggagctaaacacacaaaagaaaagacagagttctgctcttgttgcccaagctggagtgcagtggcgtgatctcagctcaccgcaacctccgccttccagattcaagcgattctcctgcctcagcctcctgagtagctggaattacaggactccatcaccatgcccggctaactttgtattt

SEQ ID NO: 261182 - DNA, 610 bp, Homo sapiens
tcacccaggctagagtgcagtggtgcaatctcggctcactacagcctccacctccagggttcaagcaattctcatgcctcagcctcccaagtagctgggattacaggtgatagaggctatgttcctaagtgaagaatgaagtagtggcagttccatcagatgcttagagccagagacagtcctaagcaaacagctggaaaagaaatccggtgagaaattccaagcaataggaattttctctgaagatcacttggaagtgccccatgagaaaaaccactagcttcaaacccctgccaagcccagagaatgccttacactgaaatagatcatcataaaattaatagcccctcaaacactgcctggctcagagttggcgcttgttaaaattttgaggaagcaagcaagcaagcacatgggaggataccaaaacatggcagtaaaaggagctaaacacacaaaagaaaagacagagttctgcactccagcctgggcaacagtgcaagactctgtctcaaaaaaacaaaaaaaacacaaattgtaaattgagtggtaatattttctataaaggtaacattaaaactgtgttgagcactattactattaaaaaaaa

SEQ ID NO: 261183 - DNA, 523 bp, Homo sapiens
cgccatttgatttcacagaaaacggaaacgcagtgatgaagcccagcgcctggccctcgccctccctccacgtctgtctcgggggcgccctcccctcgcaggagccagggcacgcgggccttcaaccgccgaggcccccgccgcccttctggacttttatcgaggcatgtacactaatacgaaagagaatttgccatttacctgtaagattgagggcgacaacgtaagaggaatggttttaagtgacgcgtccggctccttactcccactgaagggtgaaggtgccacaggtggacctggtttggattctgatgtgaagaaaccgacttcaaaacatttgggccaatcaggaaaatgcgaaaactctgactacaaatttaatgatatctagaattattgttaatagtttaaggtatggtacattatcacaaccaagatttgacatagctacagtcaagatacaggatattatcttgtatcaggtgtatcaggacaccactacaaggattactctgttttcagc

SEQ ID NO: 261184 - DNA, 460 bp, Homo sapiens
gcgctggtggtcacagactgcgctctcacccacactgaggtcgatctggaaggaatttactgagggggctctccagcagctggctaaccgggaaggaagtagaactagaagacatgctttactcttcctgaagaagatacttaagcccctcaagaagagatttaatttgagcgctgtgttgatttgtgcattccttgtaaagcacacactaaattagcttcacatcccagccgtaccttcatctgcagcacacatctctcccccagctcctctcagcactcacttagccctgttcagttcccctgtaggcacaggtacacatatatcagcctcttgtaatcatgaagacgagggacgaacttacaaagacacccggcacactgtgacaatccttaactgggagaaaaaaaaaagagagagagaaagcaaagaaaggtagaataagagcaagaaaaaaaaa

SEQ ID NO: 261185 - DNA, 399 bp, Homo sapiens
gcttttataatttctcttacagtttttcaaaataaaaacacacaccttggactcccaaagtgctgggattacaggagtgagccactgtgcctcatctagagttagtatttctatccctaccttccaaatgctctagaataccatcacgtcgcttttagtttctggttaattcttttctcttgttctgagatggagtctcactctgtcacccaggctgaagggcagggtgttgagttcagctcactgaaaacactgcctccgggattcaagtgattcttcttcctctgcctccagagtagctaggattataggactgcaccaccacacctggctaacattttaattaattaattattattattattattattattattattattatttgagacagagtct

SEQ ID NO: 261186 - DNA, 416 bp, Homo sapiens
caagtccaagaattctttgcctagatctagttcccaaaaattgtctgctataattttttccaaaatttttatagttttgtattttacattaagtcttttatccattttgagttaatgtttgcataagctgtgagacttacccaaggtattagactctttttttttttttttttttttgaccatgaatgtcaaatggctccagcaccatttgttgaaagactatccttcctccatggaactgctgttgtatttttgtcaaaaatcaactagccatatttctgtgggtctttttgtgggttatctgttctggtccattgatacatatctatccctctgccaataccacattgtcttgattactatagtaatatagtaagccttaacgttgcgtagagtggtcccttccttccacttta

SEQ ID NO: 261187 - DNA, 390 bp, Homo sapiens
ctttatatttatttcactatttttctgccccccttagatgatccagggagcagaaattatttttgtgtttcccctcaataccagcatctgattggctgaccagcaacgtgtctccaagaaatgaaagctgggttgggtgaagacaattttaatgtctcaaggggttaccttttcaaaataagactgcaccagaagactcctctcagccccagggcatccacttgctcccttgagaggacacattccatacctcgggtcatcctacgggagaaaataaaccagaagctgacattcactaggcactttagctgacagaaccatggcggatatctcggtttatccacagatagtactgaaacccaggaccaggaaaaaactaaagggtggctg

SEQ ID NO: 261188 - DNA, 463 bp, Homo sapiens
atgttccgcaaagaaagaaaaaagcatgctaccgattaaactataatccccaggaatttagagacaaatctcacaattactaaaatgtgcagaagtgtatcttagaatcagtgaaatatatttttgttttgttactttgtgtgtgtgtgttttcctaaagcttttggtagcctttcttgacaagagaacagtgttccttcaccatatttgtttggtgcccatgagattcccaagctggtttcctgctacagtttggactaattgatttaccctaaacctaagttgatcccccaaccctgaggttttccctgcgttgatccactgttcccctaacttcatgtttcttcctttttcccccttgttttggtggaatccatcaataatttcccaagaatggattggtaggaagtaacttttggagtccttaaattgctgaaaatttctttcctctaatatgactaaa

SEQ ID NO: 261189 - DNA, 715 bp, Homo sapiens
ccccgggctgcaggaattcggctttaggttttgctaaacatttaatgtcacttgaccatacaaatgtcattatgtggatgtcactagtttcatgtgctctcttccctgaaaatacccttagacatgataataaattgaaccattacagttttgtgacctcgtgatgcagttacttacgtgattcttaagaactctccgtatagtggtaaaagcaagcaagaaggaaaaaattaaccatgtaattaatgtaatacacatacagtgtaatacaaacagtattacagcatacaattagtacccctgaacccaggtgttatcctctcggacctctagtaagtgactgtgctttgcgcagtgaatctcctgtgaatagcaagcagaaagtcactgccttatgggagtagtagggccagctgtcagcctcgggaggtagaatataatcaaggaaggaaaatcttaaaagttctccgaagctatgcttatattcaataggatgtaacttacacatggcaaacaatttaaaaaatcttttaatttaatgtctgaaataatgtcacagggacatgctatccaaagagtgtaatatttgttataaaattagtgaaaatattagcacagagtttgttaatgtttttagttaattctgagttagtcttgaattaatgagttacagggcattgggcacttgtaatggcagtttgttttcccttagatt

SEQ ID NO: 261190 - DNA, 392 bp, Homo sapiens
agaagtgctcctttgcccaacaagcacatattcttcctcattagtcccatctaactccagggggaaacaagcacttagaataaaatggtagcccagtcttggagaaccactcatagttctgggattttcagagtagaacatagcatttattcatagcactggcattcatgacattaacaaagctccatatttaataagaaccagtagggttttggacacaggaattttacatacaatgtttttcctaaaatctttcaagccatctttactgaccattaattttttaatctatagaaacacttccttgagcttcttacttttcctgaataagcatgatacttattgtcatattacatcttttgtcttcctcattaaaaattttctttcatgta

SEQ ID NO: 261191 - DNA, 448 bp, Homo sapiens
acctggcctcttccagtgattcttacttcaacatgctacacatcacttccagactggcccaccctttttcccatgagtctttctaatgtatagcctttcatccggtacacaggatgaagcccaatccccttgagctagtgtctaaagtcctcctaggacaatcccttactaactccttgtggagaagagtttaatgcaccagttctgagactgctacccttagaaaggcttgcttgcaaggttggcccttggctggcaccaggaaacctggatttgggaagggctcctgccgttccctatctgagaagtggtgctcaatatgcttaaactgtgcaatcagtgtggttcctgctgaacacctgctttccctcctggagtctggaatttctgtactgctagaaagtgggtccctaggtgacaagctctcaataaaaatcttgaacattga

SEQ ID NO: 261192 - DNA, 915 bp, Homo sapiens
ttcttgtgattagcaatcaaggacagtttctcagctaatcagtacaggaagaagagcctatggtaacagacaataaaggaacagcttgcagacggcctatcgtgagactttgccttgtgatcatattacaagactgaataagatagacatgacctccttcctcctggacctgacaattgttccttcaaatcacttccacacatgcattgcctggggactggggactggggtctggatcccatggccagaccaaaccccaaaggaagctattggagaatacacaccttcgaaatgcggagaaatataagaaaaggaagacaagagttcaagaagccaggcatccaacaataataactaaagaggcaaggtaattctcaggatgatgtaacagaaagtccagactggtgaatgacaatgaagaactacaagaggtttgtactctgaaaagaagaaggaaaaaagtggaactcacagtttgtctaaagtttttgacatgtttcaaggaagtatatggttctgtgcaaagttagcaaaaggtacattaaaaaaatgagaaaacaacaaaatcaggcaattaccaactaaaagtataaagaatttggtacaaaaaaggaaattaataatacactacatgctaacttgttaacaatttttacatagtaccaatacaataaatacaatgttaatttcaaactgcaattaattatgctggaaggatgtgggagtgttaagagagttaaattaaaatcttcataacaggaagtcaacagataatacctactgaatatttctactttttggagggatgttgggttggggaactactgtttcatttccttaaagtactatttggctttttaaattgcctgtacacatgcatatgcatacatagtctaagttaaatttttaaaacca

SEQ ID NO: 261193 - DNA, 592 bp, Homo sapiens
gtgagaactctatcacaagacagcccttgggggatggtactaaaccattagaaaccatcccaatgatccagttacctcccaccaggccccacgtccaacactggggatcacagttcaatatgaggtttgagtggggacacagagccaaaccatatcagtcccttatgatgatagatgcaaaaatcattgacaaaaatattagcaaattaaacccagcaatatataaaagaataaacttcatgacaaagtggggtttatttcaggagtgcaatattaatttaacttttgaaaatcaagtaatgtaattcaccacactaatagacaaaaagacaaactatatgatcatctcaatagatgaagaaaaagcattagaaaaaaaactcattcatgataaaaactcttagccaacttggaacagagtggaacttttcaagctcaataaatggaatctttgaggaaccaacaactaacatcatgcttattagtgaaaactgtatgctttctccttacgattggaaagaaagcaaagatgtctgttccctccccttctactcagcattatactggaggttcttggcaatgcagtaaagaa

SEQ ID NO: 261194 - DNA, 332 bp, Homo sapiens
tacgctcccagtggctggggtccttaactaacgtccatctctcccccagagtcctctcccagtcaccaggtcctggcactctcccctgccccagatgtctagcccagttggcccagagggcacacagaaggtgggctggaaaagtgggaaaggcagtctggattgacttagttttccccacctttgaccaacacacccaattgggctgcagccgatctatggtcgggggaggtaggtgggaacctagatttttggaaatgtgggattggggtttcacacgaaaccatttgttgaaatccaagaaagtgataattatccctagcgattttaga

SEQ ID NO: 261195 - DNA, 421 bp, Homo sapiens
ttaatcccactaacacttggatccctttccccgtttttctaaaccaaagctatttgttctttcttttttattttgtcattgtgctccaagagaattccatttcatgcaaaccataaccttccaattacattcaaaattcatctctattaaaatgcactaagtttatattaacttaagcaacataataaaaatagtcaattcctttaaatttttaccccaatattactatttataatgtctgaaatattataaaacttttcattgtctaaaacattttatttttatatttttatttataaaaaataaattgggtacagtgactcacatctgtaatcccaacactttgggaggccaaggagagaggattgcttgaggctaggagttggaggccagactgagaaacatagcaaggcccactcta

SEQ ID NO: 261196 - DNA, 814 bp, Homo sapiens
acctgtgcatgtgccctacagctcagggtacaactaaggacttcggatagtccacacgcaaacccggagaatcacctctgcttagctcccttgtctccagtactctgccttgcacattctaaccactttggcacccacaaattccactcgctccctgcctcagctcactaaatccctcacatactacttggcctcagcttcctgtgtcttggtccagaaagtgccctcaggcagaaagccaagtaaacatgggactcgtggatgtttccctcctctcaaggattatattcttgtgttgcctgttttcgagggtctaaaaacagttttctcctacatttagctaaattcacttttataattgtttatggtgggagggcgaaatccagtacgagttactctatcatggctggaaacagaagtctgggcttaggttatactgaagcaaatcctggcaggcattgatgccatccagccagcctacaaattgatagcagtttttcgagggtaaatttctactgaattttcatcgaggttggagttgaagccaagcaagcctaattgcccagctctggcaggagcccaccctcggggctgtctggccctcatggcaccggggatgtcaggaaatcttgaccctcagtgtcccatttaaagaggacaaaaatgtgtatttgtaatgattgtgagtcatcaaagaaagagtaaatcacactccttgcactctgttaattacaacagagatttacataataggctttagacagattttctgagaaacgattgataacagtttcaatatataaaaggaaaacta

SEQ ID NO: 261197 - DNA, 229 bp, Homo sapiens
agcccttcctgggtgtgggactctgggcaagtgccctgcctctccctggtctccccctcagctcagagagtgcagttcccaccctgggaggatgtctgcaccttgcagcctcttcagcccttagccctcttggcaagagctcaagctttctcttgttaaggacgggacgcacagacatacgtgagtagatttcaggttacgtgccctaaactaataccgtgtgcactta

SEQ ID NO: 261198 - DNA, 491 bp, Homo sapiens
gtgaagtctcacctctaccaaggccaggaatggcagggtcttcccagcttcatatcccttctttcagaatcttacagagtgctgtgaataaataaacatttaataaatgtttgaatcagaatatctgctgaggcttagacctaattccatatattgcttgtgagtgggcatcatttttaccacctcccaatccatggctaacccccttgactgctctgacagccatcttgacttgagccaatgtgctggtatctaactatctccggagggaggttttacactcctgttttttactgcttcctaattggattgcttgttttgctggctaggtcacacatggctgttttctgtaggcacttcttcttctacactcccagttttaatctagttgctgccattgggttgactcgccctgcctctctctgtgtggtggttttcctcataatgtatattccattagcacagtgaagattgagttcagtccaccagag

SEQ ID NO: 261199 - DNA, 893 bp, Homo sapiens
tgagacagtctcactgtgtcacccgggctagagtacagtggtgtgatctcggctcactgcaacctctgcctcctgggttcaagcgattctcctgcttcagcctccaaagtagctgggattacagatgtgcgccaccatgcctggctaatttttttgtattttagtagagacagggtttcatcatgttggccaggctggtctcaaactcctgacttcaagtgatccacccacctcggcctcccaaagtgctgggtttacaggctttagccaccctcagcaattcatcccaccagaacaaaaggctaacatagcaaactggtaaatttatctgcacagaaaaactgaactacaagggatgaggtacttaacttcccacctgaagacccaggaattttttttttttacttttcttcattgagatagggtctctatcgctcagacaggagtgcagtggcacaatattggctcattaagtctccatctgggatcaaatgattttcccacctcagtctcccgagtagctagcacaggtgcgtaccacatcagtctggcttatttttccacccttcctagaaacggtataaaatacttagcgagcatctaattaaaacagaccgtaacctaagaagacgtaaggtcataaccacaactccaaaaccaaacgcgcgccactacaacaactctgaaaataaacacacgcaacaacacacaagccgtcttttaaactagttcaatcacaggacagaaaagcgcaaaagcagtcccccactaccacaagttatgcagccgagttttctcattcggggaaatcgcgggagcaaacacatagtaaaaaccctcccccaagaaaaacactttatcaggacaacagcgtctctcccccgccacaaagc

SEQ ID NO: 261200 - DNA, 478 bp, Homo sapiens
tcctgccggcagaggctccacattggagctattagaatgtgggctctgtacgtcggccaagtccatgtctcagagactgtatccagagcatagcgtggccacagggctactgagttcagcaagagagtcattctcttgttcaatccattattgcctgggccaaggttctaagtcttcgtaggcagcatttgattttatgacacgtcttaaaaaattaaggcaaactggaattaatttagttttgagaaaacaacagaagctgctacaaggcagagataattctaggctgccagaaagtggtgatctcagtggtgtacattttcttaattcctgattttcctctttgtgaggtcttcctcccactcccatactttgcacattctcacctatgcacaccctgagcaacacaatgttgacaacttgacttagcattgctcttttcttaagctttgttttcatttcttcttcaatacaacag

SEQ ID NO: 261201 - DNA, 397 bp, Homo sapiens
ccagtgtccatcttcctgtccccggaaggcttgaaggcattctcaccacgtcttggttctgagggtatgacgcccagccagcagccatgatattctccccgaagggcctcccaggacctgctcacactggccgggagatgctgggaacccaaggcagcctggtcattagaaaatgacggctcaggactcgggcagctacaccgtcgtgctggaaaccagcaggggacacaggagtgtgacggagcagatccatgtcaagagtgagtggggccccgcagtgggaggggctgacttctcagaaagcagacccactggacctcagaagagcccaccaggacactttgcatgctggttatccattgctccccaataaaccaccccaaaacttaaaacatca

SEQ ID NO: 261202 - DNA, 455 bp, Homo sapiens
aagtgtagagtgaaaggagcactgtttattattcctaatgagacctcttcaaccacagctgagtttatgttaatgcggtcactgttcgaaagcccataaggatggttggcttgttgtgggaggggccgacaatgtgattagaaggttggacctttttagcctacccctgacctctggggagaggagaaggactgggtggaggttgagttaatcaacaacggccaatgttttagtccatcatgcctgtgcaatgaagccttcataaaaacccctaactaaagggtttgggagagcttccaggttgctgaacatatggaggagctgggagggcgaacccagagagaccatggaagctccacgcccctttccctatgcgtgtcttccatctggctgttcctgagttgcatccttttataacaaactgataatctagtaaataaactattttcctgaga

SEQ ID NO: 261203 - DNA, 425 bp, Homo sapiens
ctctcctcctcctcttcagcactgcgtatgacacaagcagagtgccttcggagcagcttctccctctatacatgaaggcatgttggggtcaagggaaaagttcaatacgtcatgacacacccaaactgagctgctcgcacctcaacagaactgcatttaatggtaaccatgtcaatgccagccatgggatgcgtgacaagattataaacctgatgctgaggaaggatgtcttccgggtgtttttggagaactagggataaatccctaaatggctcagctgtttattgggatgggcacttgcctgtaacttgaagtaacttagaaaatctgtgcccaaagtgataccaatctaccatggctccaggtttaaacccacactttatcctttcctacaaagttccaaatggtctgagcacttagtagtt

SEQ ID NO: 261204 - DNA, 619 bp, Homo sapiens
agcggggacaatcacttgggaatcactgcttttatagtaagtggtaggctatcctgctctttgtcctggagatttctcgctgcaaacacaaccctgagaaatggcccagctaatcagtagtgggcggggacgctcagaacccgcagcagagtgcctctccccttccttctgcaatgtctccagcaccctctaccgacaaaattagcactgtgcagactggcgaaggagaaaaaggctcatgtccacgttgactgagcaggtaatgaagactggatttgtagatgagaagcactaattaaaaactggtgtgggccgggcgcggtggctcatgcctgtaatcctagcactttgggaggccatggcgggtggatcacctgaagtcaggagttcgagaccagcctggccaaggtggtgaaaccctgtctctactaaaaatacaaaaattagccggacgtgttggtgcgctcctgtaatcccagctacttgggaggctgaggcaggagaatcacttgaacctggggggcagaggttgcagtaagccgaaatcacaccattgcactccagcctgggcaacaagagcaaaactccatctcaaaaaacaaacaaactggcgtatatg

SEQ ID NO: 261205 - DNA, 3692 bp, Homo sapiens
ctgatttctcttcggctggacggaggctgcctcctcacgcggctcccaactattcccgtagctcagtgcccccctcccgccgctctactcagccaggcagacagactgacagactcgctagtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaa

SEQ ID NO: 261206 - DNA, 440 bp, Homo sapiens
ggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctaggtaagactttcctgttctctcagatatgtttcactcacactgaaacttactttccttacaaaaatcaaaaggaaacatgttctttcacattttcatgtatattatagattaaagttcactttattttacgttt

SEQ ID NO: 261207 - DNA, 3728 bp, Homo sapiens
agacaatgagggagagtctccgccgaccgcctgctgcttattgttccgggactggagactgcagccggctgctgcctagtcctccggggctccgctcctgactagctcctccgtccctctagggacggttcggggtcacctaaccctggtccccggggcgctgggacgctagccccaagccgcagccgctcttcgctgaccgccctctttctgctttgcaggtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcagcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaa

SEQ ID NO: 261208 - DNA, 364 bp, Homo sapiens
cctgtccaatgtcacccagagaggaaggggagtggagccccagtctcttggagcccaaaacccacatccttacactgagatcagcagttcttacccaggagtgattctgcccccagcaaacacttggtgacatctggagacatctgtggttgtctcaactgaggggagctcctggcatgaagtgggtggaggccagggacgctgctcagcaccgtgaagtgcctgggatggccccaccccagagaacattccagccccagcgtccacagtgccgagggggagaccccgcactacgccacactgcctcctcgcttgaaataaccagaacagtcttggggacgtgctggggaagccaggggagagg

SEQ ID NO: 261209 - DNA, 362 bp, Homo sapiens
caaaggctttttaaacatgagctcattcagtttccaaaattcctattaagtacctgcctaagaactacaattcggagttgctgcctagtgaagttgagggggtcggtggagccccgctgggaggccaagggctcaatctgttgagcccttctatgatgctacatatttcatcgtatgacaaggagtggccagaggcaattcttgaattctgtgggaggttgcagtatatgactaggaaacaaatgtaatgactgagttctgctttctatgtatgcaactcaccctaaaaacgttttgtaaggtagctggttgaagatatttggaatgtctaacaagttggctgactaatgtcatgaaaactg

SEQ ID NO: 261210 - DNA, 246 bp, Homo sapiens
gtccagaaagtaacacacgcatgcttatgtggttagaaaagaatgcacgtgtaaataagcagggtgtatgtgtgtatatgactgaggagttcaagatttaatcaaaatcagaattagtgtgactttccagtgtatttacaatatgaagaaaagcattgtgaggcaaagaaactgacctttaagcatcctaagtaaaaactgcaaagagtttgtgaaacacaaaacgttgtggtttccagttttaca

SEQ ID NO: 261211 - DNA, 378 bp, Homo sapiens
atattagggaaaattgcaaagtaggatacatgataatatttgactcaatataagaaaaactgcttcatagtttgtacacatgaaaaaagatggcaaatgaggtgttgattctaccagtttgcttatcagaaatatgattttaattcagggtaaagaatagtaactaatataaacacaaggaaataatggctgattaggtcaactaaggtattctagtggaataagaagtgtgaccaccagggaaataaatatttactttccacttctagcttaatgggtacatattgggtacttagcaggtaccaagtcagtagggaatttttttttttattacaaatttggtaaggctcacaagacaagacaattacaattatacaa

SEQ ID NO: 261212 - DNA, 1053 bp, Homo sapiens
tcaatgagcatataccctgtttactttgaagtgtttatagagaaggattttgttactaggttttaatccctgtatggtgtttgttcaccattaggccttttccctcagagatctatgagtatgttgctcttccttatgttaaatgtatatatacttacataggttgtgttgtctcttgagttttgcagttaaagtgtgattttgctacccatttggttcagtattgacattgtttttttttctgccactatgtacatttaaagtgaggatggaagagcacccttcattgaggtctgggcaggaagaggattggagaaagtggccagtccttagtagaggtgcacctgctcaggttgtgggagtagttgaactagagattaaatttggtgtgccaagtcaaatggactggtgttctgccttttggcagataactgttgtcttcagctaaaagaaagggcttgaaagccttagcagatggctttaggagttgcctatccgttgttggatgtcagttcttgattctcttatcagccagccactactgtttatccgtgtccactacatcaaacagaagagaatgaagtacacagcctggaacagggtgagggacagcacaaacctgtgctaggccctagactgcagtgttgaaatcacttaactctaatttatacatatactttctttatgttatatattctcaatagactgggaagtatgtttctcaaactttaaatcctctgacaaacataaacgaagattgtttttgatacgtgaaatttcaaaataaatactgcactgaaacaaaagacaaaatactgctttgcttttcaaagtatagttcactattgagcaacatggatttgaactgcatgggttcactcatacacagattttttgttttgttttgttcaaccaatgcacatttgaaaatacaatatttgagggatgcaaacccctcaaatatatggagggccaaaacttcacgtgtgggttccgcagggctaactgcagatttgggtatacctggggttcttggaacccatccctcgtgta

SEQ ID NO: 261213 - DNA, 1053 bp, Homo sapiens
aatctagacttgaaaaaattactaagaccctgatgttaaaacccaggagtcactctatcctccagggaaacaacatgacctacacagtgtgaaagcctcatgcaactgtcaagcacatgtgtacccacccccgtcatcataggcagccagaaggcagctttgccccactagagaggatcctgtgcagccgttggcccactccccacccaacaaccaacccagagttgaccctgccctcctagagtgattcctgtgcagctgcccagtccacatgcccctgtccccagccgtacagctgtcccagagacacctttgccccatcagagagagccctgtgcatctagctgcctggtccacatgcacccatgcttagcctgacagccagctcattggtagccctggcctcccagacagcctgccacacagcctgctggcacccaacttgcactcagcctgacaacaaacccagcacccctgcaccatcaaaactgcactaccactgtcacaaactcccacagcctaggccactgagacaattgcaggtattgcagatgaaaattacagataatgaatctacaaagaccacaatactgagtccagccagaaccagagccaatgcaccattctcaacagacactctaaggaactatctaccaaaaaaaaaaaaaaaagccacttatttcaaaagctactttgtaaaattggaaaaggtgactatttcagtagaggttcagatgtcagtgtagaaacccaagatacatgaaaaagcaaggaaacatgacatctccaaaggaactaaataagactcccgtaacagaccctcaaaaaaggatatttataaaatgactgaaaagaattcaacatagtgatcttgaagaaactcagttcaatacacaagaatacaattcaatgaaattaataaaataacccatgatcttaattagaaattcaacaaagagatagatgtcacaaagaaccaaacagaaatcttggagctgaaaaatgaaatgaataaaattgaaaaatcaattgagaacttcaacaacagactga

SEQ ID NO: 261214 - DNA, 502 bp, Homo sapiens
gtgtggggaacacattcaaatttgtattttcaacctatcattttgctgctgagtggagaatacactgcagagggaaagaggtagaagcaaggagacaagttgggaggtgtttgtaggaactgaggcataatggtggattggaccagggcatggtggtcattttggtagaaagatacagatatactctatagagatatttaggtaatattgttgtcaggagttggtggtgaattgaatatgagagtttggaagaaatggctgacagtgatggtgactcccaagtttctggcccattctgttggttatacagtattttttagatataatgttaatatttttcccaatttgtcttttgttcattgttggtttctgataaatactctgtcatattaaggaagtctctatttttagtgtataaagcattttgataaaaaatgattctgcattttctttccttttgtttattaaattacattaatgtaaataaatatataaatagatt

SEQ ID NO: 261215 - DNA, 1675 bp, Homo sapiens
  misc_feature (352)..(352): n is a, c, g, or t
  misc_feature (368)..(368): n is a, c, g, or t
  misc_feature (757)..(757): n is a, c, g, or t
tcttgagacagggtcctgctctgtttcccaggttggagtgcaatggcatgatcttggcttactgcaaccactgcctcccaggttcaagtgattctcctgcctcagcctcctaagtagctgggactacatgtgtacaccaccatgcccagctgatttttgtatttttagtagagacggggttttgccatgttggccaggctggtctcgaactcctgacatcaggtgatccaccagcctcggcctcccaaagtgttgggattacagtcgagagccaccgcacccggctccaactgctccttttaaaccataatttgtatatattcttctttagaaagcaaaacaaaagaccctncccctttaagatttangtcatcagccacaccactggccccctcttcagactgtcacctatggacttctaatcggccttcatctaacagtctttcctccatctcgggctcggccaccctgccgtggcttagcatcatgcggaaaacccaccgaacacttcttcagtccagcttcctgactgcctccatctccagtggccctttctccacttttgatggggttccaccttggatcttgtcattgccagaactgctccaacccccaaatcaccagttcaaacacctgataataaagccccctctcctccttccaggagatttgttcaaccactaccactgcaacttgttttagccctgtctggaacccagtccactgactgctcatctttctgcaactcacaaccccntcctttgttcgctttcctctggcttcagttcagatcccatgggcttatcctttcaactgcactgctatcagcatgctggcgtccccgctgctgcctgcaccctgcagccccttactgtcttttcatctcacctgttggtcaagaccccaaagctggcttaagcctaaccatcccattccccctgcccacactcaaggagctggggggactagtcataatcaccagccacataacatttctgggagtcatatttctatctctacttagctcactttccttctgtctagagccaccagtttgaaacttccccattttcctccaactgccaatacccaccaccacccattctcagcagatgatctctacctctgatttccttttgcaattaatgacataaatgtcattagctacatgattagttgttaagtcatttatgtcattaattgcaaaaggaaatcagagaaagaaaagatcatcaccaatgctgtggctgggaggttaaggggaaagcagtgacagtagggaaaaaataacagcacaggagaggtactgccatatgcagagaaaatacacctagaccttaaatcttggaggttgtttacagtaatgagaaaggcactactaaaacagacccactgtttctaccagaaaagtctttaatataaagtactaatattatctgctgcaagtatatgaagttattgtgaaagaacactgctacaagcacaaatatgtggactttaagcatttcataacttttatattatgataatgctcttcagaaaaaaaacaatcagaaacacacacacacacacacacacacagaaaaatcgccaccaaaaagtataggtaaaaaatcagtaagaaaattaaaatgaaattctttaaaaaatttaaacaataatttaaataatgtat

SEQ ID NO: 261216 - DNA, 333 bp, Homo sapiens
gactatgccattgcactccagcttgggcaacaagagtgaagctccgtctttaaaaaaaaaaaagaaagaaagtcgtgggtgagcctgaaaccgaagcctttctggatgtactgggctccccaagtctgttctggcccctccgtggtgcatgagggtgagtgagcctctgaagcaggcagctctctggtgtccatttctcctcagcacatttagactgaatgtgtcagaacccagaacacatgatgtttatttttttccatttgtgtttcactgctcccccgccccctcccccaaaaggagaaagccaaggacttagaggtattccctgagaac

SEQ ID NO: 261217 - DNA, 684 bp, Homo sapiens
atgaaaatcttggaagcacaaagtagacatcaaatggatatttgctaggtgaataaatcactgaatgaatgggcaaatttatgaacaaatgaatgaatgaatggctgtcaggcaatgggagcacagttgaggtaggtgggagcagggctcagtcaggcatctggctgcctctggatctcacctggacctggagaccttgtagagtctgcggctgcctcagtgttcccaacccctgccggaccttgccgtccctttgtgccatcctctctccatccccactggcctcctgctggctcctgctggctcccgtgggctgttaggaagagtctgggcctgttctccatacttacgccaccttataggacagagcagctgctcccctgccagacagtagcaagggcctttactgagatgtaattcacacaccaagcaattcatccctttaaaatgtacaactccatggtttttagtgtacgcacagctacgtgcaactatcaccacagcaaatttgagaaggttttcttcgtttcaaaaagaacccctataccctttaactatcgcctctatggagcctttctcccccaaccccctgcctctgacaaccactaacctactttccatctctctagcttcccctggcatggatactcatgtgagcagggcatatggcatgcacccttttgt

SEQ ID NO: 261218 - DNA, 315 bp, Homo sapiens
tactaaattcgcggcgcgcgtctacagaagtccccctcccccaacatcattcatcaatgactcatgccaagataatgtccacatagcatgtatcaccttctgaaatgatcttatttactattttttcatgtattttattgcctgtcttcctctaccaaaaagtgagccccagagatttgggtctgtttattcattctgcatccctttttgggccaaggacagagtttgtcattagcactatctcttatctcttaatacttattaatgcacaaaaaactaagaaagcataaattaaaaataaaatacacatctaca

SEQ ID NO: 261219 - DNA, 255 bp, Homo sapiens
accattcagcaccagccactaatgccacagaaacatcaatccttccacctgtctgagtttggcaagttcacgtcattgttggcaggaggcctcagttcttcgctacatgaacttctctctagggctgcctaagtcttgtcatgacatggcagctggcgtctctgagagcaagtgacccaagagcaagacagtgtcaatgtcttttataatctagcctcaaatgtcacaccccctaatttccataatatcctattt

SEQ ID NO: 261220 - DNA, 671 bp, Homo sapiens
  misc_feature (669)..(669): n is a, c, g, or t
ggaatcctttgcgggtccggcctccgatccctgtgtggctgtttggcgggtgggcgctgtgttcctctctcgtaaagccgtgcgttctgtgggccgccattcagaaactggatggacagcttcggcggtgggaagggaagggacatgctgcaggccaccctccggctagaaggagggagtacttgaggaacaaggtctgcgaaaattggctgtgctctgttctaaaacttgggaatggcctcagtacctggggaatgtgtttaaaatgcagacttaaatgtccgtttctccattctaatttcagtaggtatgaatctgcgtttttactcctcacaagccttccaagtgattctgaggcaggtgctgtgctgtacttggattatcacagggttagattatcaggctatttatgatttagctgtatctaaaccacctttccctctctttcctcctttgaactgtttgaaacggatttgttcccttctgtctcttatttttcagtgctgtaagctgttaacacacatgagactgtcttcactaccaaaccaagtctcctaaagctcacttgaatgtctgcttattcgtgtctcttactaggttcaatttcttggaggccgtgattatatctatttaacgcttttccttgtacctaataaaatgtctggtgcnta

SEQ ID NO: 261221 - DNA, 477 bp, Homo sapiens
  misc_feature (475)..(475): n is a, c, g, or t
ggaatcctttgcgggtccggcctccgatccctgtgtggctgtttggcgggtgggcgctgtgttcctctctcgtaaagccgtgcgttctgtgggccgccattcagaaactggatggacagcttcggcggtgggaagggaagggacatgctgcaggccaccctccggctagaaggagggagtacttgaggaacaaggtctgcgaaaattggctgtgctctgttctaaaacttgggaatggcctcagtacctggggaatgtgtttaaaatgcagacttaaatgtccgtttctccattctaatttcagtagtgctgtaagctgttaacacacatgagactgtcttcactaccaaaccaagtctcctaaagctcacttgaatgtctgcttattcgtgtctcttactaggttcaatttcttggaggccgtgattatatctatttaacgcttttccttgtacctaataaaatgtctggtgcnta

SEQ ID NO: 261222 - DNA, 782 bp, Homo sapiens
aggcattggtcaacttaggaaatgggccggacaatatcactggcacactgctaagtcctatatgtccttcccaacaatttcaaaatcaagggaagtccagatctcactatggtcacatctgcagctgtaagggcaattgcctaccggaaatactgctgcataatttaatgcttaatttaataatttaatacataatttaatatgttggtgcgtgtatgtgttcattactggtgatcgtggatgacctgtcattagcaattcaccatcagtgggtaaagggctctgtggagatttttcaatgttttttttttcttgagaaggcacagggtcgcacacagaaattcattcaacaagaactattaaaaccctgtggactaaccacttttttgggagtttatttgcagacgtaaaaggcagttcctgaactcaaagaaacctacagtgcgggggagtaagttatgaaaagaaggaaacagactatcacgtgatatgtgctctgatgaaagtgagcccagattttcatggccggagaaggaaaagaaggaaaatcctggtgggaagtgatttctcatgaggaatcagtcatgaagaggaagggacaagaagagcattccaggtagtgatggggacagcacatccaaaggcagaaaggtggagaaagctgagtttgcactggaatgagggggtgctttaccatgcccgaaatttagggggttcagagaagtggcatccaaatgctgtcctctggtccctcttggccccatagctgtaagaccaatgct

SEQ ID NO: 261223 - DNA, 434 bp, Homo sapiens
acatctgtaaattcaatcagaagcatacagacaaaatcaaatcttaaaaaaactgatgtctaagtcgtactccagcacgtatattggatgacattatgtgaaagtcacaggactttcccgtgtttccactttgttaatgcaatattgcaaagccaacatgcccatttttacccctagtgtatagagcaccgtttgtttgagaacaaacagaataccagagctctacagcagcttcagaacagcagggattaataaatggatggatgccaatcaaagaaacctcagcctgtagctgagctatctgagaaatgtcccaattttgtaattgctttgcagttctgtgatagagtaaattgtgttttcacttctggatttataagtaccattctatcttgttaactaaaactaaattaccaatgcatgccaagaaaaca

SEQ ID NO: 261224 - DNA, 499 bp, Homo sapiens
ctcctggattgtgttcataagaggaatgtgatcctcatccttctaaactttgtctggagtcacagaaagcaaggaagttagagaaacatcctgtcacacagctttggtacctgtgtggggagctaagagatctgatgtccagttccttccagtcctttaatgaatttcctctgtgtccatgagctatctaacatccatgggaaacagttgatcttatgccaaccaaggggcatggaccagatgctctcaagagtctctcagtcagctctttgctgagggaccttatgcatggaggaaagtgcacacatcgctaagtggatagcttgatggaatagttgttacaaaatggacacacttctgcaatcagcacctgattagtagaaaattaccagcaccccagagccctcctcccctcatgctccaggagcaaccggtatgctgccttgtgatgcctttgtttagtttgtttttatgaatagaatcatacagtgaatattaa

SEQ ID NO: 261225 - DNA, 491 bp, Homo sapiens
tgggggagtcaaaagttgaacatggatgttttactgtacagggggtcaatacccctaacccctgcattgtttaagggccatttatataatggtacattggacaaaactatagtggtagagaacagattaatggttgccagggatggagacaagagtggatataactataaagggatagggatacccagtgaagttccttggtggggatgaaacagctatcttgatttatagtcgtatttgcagtaatctgtaaatgggaccaaattgcatagaaagaactatatacacacatacacacacacaggagtggatgtaaaaactggataaggtctgtaggtctagttaacagtattgtaccaacgtcattttcctggcttttaaattataccacagttacataagatgtcatcattgggggaagctgagtgaaaagttcatgggattcttggtactatttttacaacttcctgtgagtctataattatttcaaa

SEQ ID NO: 261226 - DNA, 646 bp, Homo sapiens
ttagacttactaattctttaacatgcgaggggctgtcgtgtgcctggcagatgttcagcagcatccctggtctctaccccttgatatggtttggctctgtgtccccactcaaatctcaccttgaattgtaataatccccacatatcaaggacaggaccaggtggaggtaattgaattgtgggcatggttccccccatgctgttctcaggatagtgactgagttctcacagatctgatggttttataagcatctggcatgtaccctgctggcactcattctctctcctgccaccctgtgaagaggtgcctttctccatgattgtaagtttcctgtggcctccccagccatgtagaactgtgagtcaattaaacttttttcctttataaattacccagtctcaggtatttcttcacagcaacgtgagaacagactaatacacccctagttagtactttctcagatatgataaccaaaaaatgtcttcagacattattaaatgttccttggggaaggaaattgtccctggatgagtaccactggtatataggaaaagaactacataacagatgaagaggtagggaattttaggaatgacatggcacgtataaaaaagaaagaaagaaattctggaattaaaaatacggt

SEQ ID NO: 261227 - DNA, 558 bp, Homo sapiens
tgggtggccgcttgctccggtcggtagcttggcttggcctgtcccgagactagggggcacttgtccggggaccccgggtggggggtctctgtgagccaccaggcttctgtctccaggactgcgaggtctaggtgtcctgtgcaccttcgctgcatgccctgtcctctcccctagaccccggcctcacctgtcacattgctgtctcctgggggccactgtcccctgcactccttcctctcatggggcagcttcttggcgtctccttgttgccttctcagccacggcctccttggcctctgtgtctgtctcctgccctcgtcactgatttgcacgcacacacacgcggtcacctgactttgctcagccatcaggaccctcctttgggatccccttctccagccctgacccatctctcaggcttcaacagagccacatctgccgaccctctgtccccacccagccctcacccttcccactgttgctgtctccaccctccccaaggttgggtgggtatttccttctacagggtcactggggcccttctcacaaaaattagca

SEQ ID NO: 261228 - DNA, 681 bp, Homo sapiens
ctcatattaaagaaaaatatgagtacagggtagtattgacatgatatagcgccacaattctgaatgtggtatctaaatgactaatgtctgggaaatgcttgaaacacctacactggagatgtatagccaaccaaccgaatatcttcatttttgtatcaatatttggtacctgccaactttttaaaaattttattttaatcccctcctgctttgttacatttttggcaaagagggaatggtctatggatgagggttgaatgctcggttctttttttttttttttttttttttctgagacagagtctcgctctgtcgcccagactggagtgcagtgaccggatctccgctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatttcctggcctcgtgatctgcctgccttggcctcccaaagtgctgggattacaggcgtgggccaccacgcccggcctgcctgattctttaggaaataggtcttcaggacccccacacttaatcctgggatgtgaaagtgataagtctcagtcaacttaggtgcaatgccttatccaggtatga

SEQ ID NO: 261229 - DNA, 277 bp, Homo sapiens
tgagaaatgatgcagaaccaagccctcagatcccagatcacccacggctcctgggacatctctggggaagggacttattaatgtagaccctgatgcaacatcccaagtcgtctttatccatgatttgcacagccaggacactctggggctgggattgggaggagaggaatggccaagttgccctgcccccttggctctgtggactccagaaggatggtcagtaccagcagcatttcacacacaccagcctcattattaaaattggagcaatttgtga

SEQ ID NO: 261230 - DNA, 323 bp, Homo sapiens
aaaaaattcccactctatccctcccattgtagttactatggataaagtaaaaatgagtgctgtgatttttattaggtataataatttaattccctcaattagagttgcattaccaacttagttataattcttatccagcctatatttgttaaaagaaataagtccctatgttagaccctaatgtaaatatagttatagtcttctttaaattagtaagcaagaacttttctagcttgtgcatgtgtctgtgtgtgtatgtatgtatatgcacctatatatcagaagattttacaccaacctctaacctcaacaacatgtctttg

SEQ ID NO: 261231 - DNA, 538 bp, Homo sapiens
caggataatctgtagtggcatataactccatcagaccagacagaggaggtgaggactagggaattgggtctttccctgggggcctcaaatcataacaggtaggagaccccatctttgctacacacaaaggcaaccttgcatctgattaaagcagaatatcatggaaggagggtttcttgaccctgcatcatgactgtgttcatagcagcactccagggttgaccagttatggtttctgcgcggcaggaatctgccattctttgcctataaaactgacagtggcctggcctttcccactctgaattggattgcttaggactttttgtttgtttgttcattgtattctctttgttaggttggttggtggctgattttgcccttaaatctattttgtcatgcttgcctgtattgaacctcatagaatgttttgaagaatttcgttttccaatttgctgagttattttaattcttattccactgagcctttaaatgtacaagtagttttatctcttgataaaaattaaagtgaccctgggcc

SEQ ID NO: 261232 - DNA, 212 bp, Homo sapiens
cgtgtgtccctagttggggaactttccaaattcccactccccagtgatagctccggaggcaagtcgtcttcttcctttgctcggggtgctcttgcctggtgcaggcagcggaaccccaacccttcctgcgccgcggcggaaacaggggctcggaccagcctcccgaaggagcgctgtcggggctggcgcttggggaactggttacacaagca

SEQ ID NO: 261233 - DNA, 345 bp, Homo sapiens
taaaacaaggacactgcctcttacgtgagaaacgagagccaggtacataggaagtggttaatatatggcagttgtattaaaaactacctatgagacttccaggcattggaggcacaggtaataagacctcctacctcgttccaccttggtgtttcccctcctacttgagcgggattgatttgcttcctggtttataatctgtctcctccacaggttccaagctccgtgaagggcctatcagtctttctcattgttgtgaatcttcactggtgcagtcttgtgcacctaagacactgttggtacatagtagatgttcaataaatgtgtggaattaatgaatacaca

SEQ ID NO: 261234 - DNA, 415 bp, Homo sapiens
cgtggtggcacatgcctatggtcccagctacttgggtggctaagatgggagcattgcttgagccagggaggcggaggttgcagtgagccgagattataccactgtactccagcctgggtgacagcatgagactctgtctcaaagaggaaaaaaataaaatcaatgtttcggcctttttgggaagaagtaaatcattatctgtcatgtggcttactgtagtgacttctctgctcttgcccctgcccctaaaaccttttctccatttctccacccaaagcccagagtgggttcgggtggatcctgtcactcatttgctcagaaccttgccgtttcacgcagattcaagggcaaagtctccatagtggcccactcaccttagacactgtatttgtgagctcttggccacacatctctt

SEQ ID NO: 261235 - DNA, 159 bp, Homo sapiens
tactcaacatagtatctttgcattcacccaagttgttgcatgtaccaaaagcccattccttttcattactgaaaactcttccattgtatggattatagatgcaacacagatgtccttctttcatctactggaggacatttggtttgttttcaggttggg

SEQ ID NO: 261236 - DNA, 442 bp, Homo sapiens
  misc_feature (428)..(428): n is a, c, g, or t
tgaaagattgggattgccaaaagatgtgacagagatgtgaagtgagcccatggtgttggaaaaatggtgctggtcaggcttgctgagcacttcgtggccacaaatctttaatttgttaaaaaggtgatgttgccaagcaaaataaagtgaagctcaaagtgagatgtgcctctattttgatgggctctaacaatttgtcttttcattggtgcatttagaccattgacattcaaagtgattatacagttggattaattttgccatatcattttccattaactcctattgttctttgttcttgctttgtcctccactctttttctgccttttatggagttgatgattttatacgatttttgtttcctctcgttgctttttttttttttttttttttttattgagacagcctgggtgacagagcaagactntctaaaaaaaaaaa

SEQ ID NO: 261237 - DNA, 3518 bp, Homo sapiens
aaaggaagaagaggaacacgttgctgtgtgctcgtggcacgtggcctgttgggtcctttcgcagtcctttgaagcagttgcttttactgtcccctgttttacagaagaggaaacagccaaggtgacttaagggcagagcgccagcaggtatggagcctgaatttaaatgcaggtctgcatactgcaagcacctgggttctctccacccctcctctggactcccatttgttctctgtcagtgactgagaaagggtgggtgggactaggaactcagcttccggtccatgaccacatccatggaatatgggaggaagagatcaaatcacaaatcttgggagtgagggagagacacatccttggggctactcaagtcccccatatcctttgcataccttctttatcccttttctacccagtggatttggagggagtgggcttgggataccatcagacaacgagaaacacgatttgcaggactgtgtggaggtatccaggcctgagggccctgctccagagctcccctcctcactctgtggctggaacaaaatctcttccttgtgtggccttggcttccctagcagggatcccaaaacatgggatctggccatgctgctcagtccttgggttgatttctttgagctccagcttctctgagcatcccctctgctgtccccacatcctgatagcccctctgggagctggggcctggcctttctgcccattctcaacaaacactcttgtctggagacaggcaggacaatggagagctaccttgtcctgctgctgcccctgccaccacagctgcttatgtgtgaccgatggggttgagaggggcaagagttctgtggagagagtggagggaaagagtttttttttttttttttttttttttgctatgcacagttcctcccagcaaccttccctctctgaccaatggggcctctaggctctgcccttcacgttggggtcttcccccacctccggccctttggttttgatatggctagtgaccagcactgaccaccatcccaagctgggaagagcaattggtgaagagtgtgtgtactatttactttcttcacccttgcccctttattctcaaggtcttttgattgtgaagcaaggcccgaggccttgactggtgagattagcccgggaggtggtggctccctcctgctctctgtggtgaaagccaagcacactttcctaaaaccagcgtcggaagctgtgctgtagcctgtaattactgacatgaaggtccccacacagagtctggatggaggctgccctggaagcagccccgggctgggaaagggctgagtgtcaacaggcctgtgtttgaatccaagtcacctgtgttctctgacaggtcactcagttcctccggccacagctgcccctctgtgagatgacataacactgcttacctcttggtgtggctatgaggattgattgggctgatgtgtagaaaatatgtaatgcagggcttgtcctggaggtgatgttaggtaatggtgaggtggatcttccctgtgtggtccctcccttcgtgtgcccctgcccagcctcttggcacctcctgtttactccccgagcccccagattctcacctttgcccagagccacattcgggcttgtcttcctcttccatgtccccgcatgcagaatcctctctttcttctgccagggttcttcctctccaagccctcctctgaaccagctatccctctggaatgcagctgaccaaacaaattcccactaatgtaactggtagtatcttagaggtgaactctcctgtgggcattttatttgtatcttagaagaatttttgttttaaatcttatttttcccaactggcatatagtagggtgctcaataaaggtgggttgcctgaataagtgaaagaacctaaggaacaatgtctaatggtggaatttcagtcatgtcttcatgctttcagcctctctgcaaacatttattttgtgtgctagatactggagatatgttgctggataaaacagccacagtccttgccctttggaacttccagtatagtggggacaatcagttaataagcaaacaaacacatttctatttataaatggtgataaaattccttggctaaaagaatattgcagagtctatgatactgtataacaggggcttctaattaaatttaggggatcctgatgccacttagcagtgggatttcagaggacctttcagaggagctaagcatttatcagctgccgcttattcattgccttgattttcttcaaaagacaactataatcattcaaaaattccaagttgggtccaaaatgtcaaaggactctgcatgctgctgaaagcaaatgaatgtggagggtttcaaacaagacaaaaggcattcctccctgcccaatcccagtgcagtcaaggccaacctaggcagcagccaccttctcaggaaacaaggccttggagaaatcagtgcctgtgtgaagatggtgtcggctgaaaagaagagcaatggcgtcaagtactaaatgattatcaagggtcaacttctgtatctgtatcagctgcaacacactgtctttaatacccccagcccaggagctcgtgccttacatgctgggcccacattctgccccaagcagaagctgcagggacctcagtgtccacccttcctgcctcatgtctcaaggcagcagctcctctctggtaacctgatggtgatgtggccagggtgccgagatgggacagcaaagatgatgggctctgcacaccaactccaggaaactcattctgggccagctctatgcaaagggaaaagcatgttgcattcacctaggccaagaaacagtgttgtaggttaagggcatggactgcttgagttcagtgccagctatgccacttaccagctgtgggaccttgggcaagttgcctttgtgcctatgcttccactttccttttccctccaccatgaagatgggttaagagtctcaaggttgtggtgactgtagatatatgagtgtgcatttgctatgctttacctgtctggcatctagcaaacattcttcacatgtttgctgttatcaagattgttgtatatgtgaatgaaatgatacgatgtctcagatttgctttaaaataatagggaggttggggaagtgggttggggtacagacgaaacaggagtaggtgtgagttgataattgttgaagttaagtgatcagtacgtgggtttattacactattcttttcacatttgctttgaaactgttcataaaaatttccataataaaagttctatatatatataaatatatacatacatatgagaaaatgatgtttatagcagagcttcactagacatggtatgtagcatgtagtgcacaagctgattttaagtgatattcagatggccttttaaatttaattattatgtatttaaaatttaattaattatagcaagtgatatgaactgtgataatgcagaaggtttccttttaaaataaagttcagtcaaaaaa

SEQ ID NO: 261238 - DNA, 617 bp, Homo sapiens
gcagtatcttcctggattttttcactccagccacactgactggccttcattttttccttcaagagtcttcaccctagcatttcctgctgccttaaactgctccttctgcttaatcttcactcaccctcagaaagcaaaggattggcttttcaaagaagtttttctgactctttcatattaacacaggctcttcctctgcaatggaccgaatgtttctgtccccatcccccaaagttcatatgttgagatcctagactccaaagtaatgattttaggaagtgggtcctttgggagcatgtggatctcagacttccagcctccagaaatattaggtttcagctctgagggaaaaaaaaaagtatggtactggcatagaaacaaacccatagaccaaaggaatagaatacagagcccagaaatacacccgaacatatatagtcaactaatttttgacaaaggcaccaagaggacataatgagaaaataatagtctcttcaataaattgtgctgggaaaaactgtattttcatattcaaaagaataaaattagacccttagtttacaccatggatgaaaggcccaaaagtaagatcagaaactataaaatttctagaatag

SEQ ID NO: 261239 - DNA, 675 bp, Homo sapiens
  misc_feature (607)..(607): n is a, c, g, or t
attcattattcacttcatctttttttcttacatttctcatcactctggcttttctatttttagcaacagggtaatttttttgcttttttacaaaattttacattaaattgcattatatattttctaaatattttctgtattggttttgagaatttactatagatggagaagttttcctgaatattatgactggaaagcaagtgtcaattgtatcatgctagcaatgttttaattgcgtcgtacatagcaaggggtcaggactcacaggctgttctgtgctctctccatggatcctcaaagatcactttgtgacaaatgattctatagctgatgcagagaaatgtcatttagaggcgaatgcctggttgttgcttccttttttttagcatatatttttaataattatgtcattttacttcatgtatgctaactaatgattcaagttttgtacaaatatgtaacattttaacttaagcaaacaaaatttaacacttattaaaattagaatgactgaagaaacgcaagtaattttatgttattctattctacagtaataaacatttatgaaaatctaacaggcttgatacgtcactgggtcctttcaacntgggttttgatctactgcttctggttgctttgtgaagaagacacttagacatgttcgttgttgcttgt

SEQ ID NO: 261240 - DNA, 655 bp, Homo sapiens
cagattgtagatgggtgcacacaggaaaatgtacagctcctacaatgtattctgaggaaaaaaaaaacatacaagtgggggaataaaagaaggcaaagagataatggagaaacttcccagtctattcaggcctgaatccaagaagggacaagaagaagggcactggcttttcctcgaagtgaaggatgtgggattggcctttggaatgtcttggaccatcacagaaagcagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgttattaaacaaagtgaactaagaagcct

SEQ ID NO: 261241 - DNA, 696 bp, Homo sapiens
gtatcagcatagttactctgtgatgaagaaaaactcagaaaactatccagatgtgggaatttctcgggtattccttgcacttgaacttaaggatgaatgaaggtatatacaagtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacaggcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgttattaaacaaagtgaactaagaagcct

SEQ ID NO: 261242 - DNA, 594 bp, Homo sapiens
cagattgtagatgggtgcacacaggaaaatgtacagctcctacaatgtattctgaggaaaaaaaaaacatacaagtgggggaataaaagaaggcaaagagataatggagaaacttcccagtctattcaggcctgaatccaagaagggacaagaagaagggcactggcttttcctcgaagtgaaggatgtgggattggcctttggaatgtcttggaccatcacagaaagcagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaatttt

SEQ ID NO: 261243 - DNA, 365 bp, Homo sapiens
ttgtttttcaaaaatagtgggggtgttcccccttatgctttgtcctttgtgtcttaagttattttaaatgtcatccctgttctccatctcattcttctgtgatctcaaattcttgctggttcttcagtctgctgactcttgcttatggtgaacgtttccacgtgagtcttatggcttaggcttgtgagttcattttcaatggagatttaatctgtgggtgtcccaggttgactggattgagggcatatctatccagctaggttttgtttcttcttctagggaccttaggggtatcattggtctaaaacccatttttttttttttttttgcatattttcaacttgaaagttcctggattaaaaaaa

SEQ ID NO: 261244 - DNA, 400 bp, Homo sapiens
agaggctgcagtgaaccgaggtggcgccactgcactccaccctgggcaagactctatctcaaaaaaataaaaaaaaatttatctggtagatgtcattccagttagtgatttgctgttagaattcatgaaattgaaattgtaagctccagagctgacctgcttatcacttcagtaaataattaccctccatgggtctcagatttttaataatcaaatagcaccatgtatcttgatgtacaaagcatgtataaaaatattgttggataaaaaagaaagtttcattttatggttctctgtttttcttatctcttcaaatagggtaggaacgatgacttatatttttattctaacgctgcagtgactagaatagtaaatgacactttatatatccaatcaatac

SEQ ID NO: 261245 - DNA, 379 bp, Homo sapiens
agatgattacagaatgagtacttattcctctgtcccactaggctttcttttcctcctcttcccctgcgtgattcactgcttggccagtgaactcccacacattcagcaaagaaacaagacttccaacattactggagacacctgggaatatggcagggctgttaaaactggctggccattttctctaagactaaaaaaaaccctccaaaaacaagacacatcctcaaaataaatcaaagtaacagcaacaaaaaaatgatgtctaatttttaaactatctgtctaaagtctttgtgccatcccttacatttcttcatacctcactgagaaactcttatatggagctataaaaatgaataaaaattaatgtgaaatgaaa

SEQ ID NO: 261246 - DNA, 402 bp, Homo sapiens
agcaaattctggagctgattcgtgctcggccccggttttgacattacaaggaaaggattccttggtaaaaacacatttaaagccagagtttgtgaaggaaaggaattttctccccgtggctgccagaaagctcagacttggcaccaccaccaagtgtggagcagttcccatttgtccctgtctgggagggaatgctgctagcaacatgtgaaccaatacgtggccctcatgtctccccatgatagaaaaagagagaaaccaagaacatgcaacaaaaactgttacgtttgctttccaaaaagaggttcattcattgaaaatggattttccagaaggaaaacaaatcaatgacttctgttgaaatgtttattcagagaaaaatgtctttctgtagttacagga

SEQ ID NO: 261247 - DNA, 157 bp, Homo sapiens
ttgcttcagggactatataataagactttcaaggctggcacctggccaagggggagggaggggccaagcacatgaggggccacagtagccagcatctagggtggcaggagagggagcagaaatagattagatttgcctccagtgagaatttgcggtc

SEQ ID NO: 261248 - DNA, 377 bp, Homo sapiens
tccactttaaaactgacaaatgagtgttttcacaagtaatctcctttaggaaactgagagtgatgtttggacaattatgaattaccttttaaaaattgctatgtaaattattcattaatagtttagagaatttttatgctaatcattcacttctagtcataatactattctagtaaaatatgaaagtgctatgcagaattagttgggaaagcaatgtaaaagagataatttgttaccaacagctaaaattgtatggtaatgcctttttgccacatggcttaaaaatacccggaaaaaaaaaagattttaaagacttcaggtgaatttaactgtattgttctatttactctagcatatcttttcaagtagtaatagtt

SEQ ID NO: 261249 - DNA, 488 bp, Homo sapiens
aaaacattacaataaaatgactcatgcaagacacccaggtagtttatagcagctaataaaaacagaataactataaaatatggtaagtttataaaagttacattgagtatactttataagaactgcttattgagtttgcctaataaccacacagcacaataataatatgtatatatttttaaatatgtgtaaatatgtgtaacacaaacttgtagaaggtatatctgagtacaaccctattctgtttggttaccttttctagttcattatgtaagtggcatagctacctaaggacttatgcttataaatgttactcaaaaaaatacagaggacatatgtggatagataatggaagagataagataggtaggttgaagggttgggctgcccctccacacctgtggttgtttctcgttaggtggaatgagagacttggaaaagaaagagacacagagacaaagtatagagaaagaaaaaaaggggtccag

SEQ ID NO: 261250 - DNA, 652 bp, Homo sapiens
  misc_feature (639)..(640): n is a, c, g, or t
  misc_feature (645)..(645): n is a, c, g, or t
gctgagactcaggggcagcaattctgatgaattctgaacaatggtaaaaccgatacctttaaaattcaagaatgttgagttctaatggcagtttgaccattgagatattaatataggaacatcatttagcctcttaagcttgaacatccattaagtgggaaaaatagtgctcatttcctagaggtcttcagattggctaatcaagttttgattttgctggtaagtaatgagcaaattttcttagatgtgatcgcttcattttctcttatattgattggcagcagccaaatgggcattccagtccctaatctcctgcaagagaaacacttctatttcataaatctggtaatttttgagctcttttcccaacagggtgctgcagctcaccaagcggaacccacagcattttctgctaccaggatagcagcttgccagtagcatatactaaattactgggtttcagtatgattttggctggtacagacttcaatcatcgaatcgacatgcgttcagccattctcataatgaatgtttccttctctttcaaacattctcagtttattggatatcccattactctttttgtggagaaggaacgtgataaagaagtaagcgatgatgaggctgaagaaaaggaanncaaanaagaaga

SEQ ID NO: 261251 - DNA, 1854 bp, Homo sapiens
  misc_feature (1490)..(1491): n is a, c, g, or t
  misc_feature (1651)..(1651): n is a, c, g, or t
  misc_feature (1660)..(1660): n is a, c, g, or t
gatggagtatcactctgttgcccaggctggagtgtagtgactcgatctcagctcactgcaacctccacctcccaagttcaagtgattctcgtgcctcagcctcctgagtagctggaactacagatgtgcaccaccacacccggctaatttttgtatttttagtagagacggggtttcaccatgttggccaagctggtcttgacctcctgacctcaggtgatctgcccgcctcagcctcccaatgtgctgggattacaggcgtgagccaccgcgcctggcctgtacatataactcttaaaatgctgccctgaccctggggctcactttcaaagatgtccacactctgtaggccaggaccccacctgtcccgtacccttcctggcagccctgtccctgctacatcgcccttcagctacaccagctttctttgggtccctggaccacacctgataccttcccgcccagaagtgttatctctgtcctggcagttgctcaaccttttatggtccctaccaccaaggccatctgcttggttgacatacccaccccaactgtaattaaatcatccccggtgtctcctcactagacagctccacataagcacagctggtccttttagggctgtgtccccagcacctcccacaaaggaggatgcagttcatcaggatgggttggatgaacagcccattttacagatgaataaactgaggcacaggcaggtgcagaattttggcagcactgcacacctgtcctggctttgtcctcctccctggggaatgagcttggagcacccctctaggaactgggatgccagcctcttcccttgaccatcttggtccttgtcatgtgggccccagtaccaggggtggctttaatttggctgcccagggaggtggttcagggctgccaggacccctgaagtaggctctctgggctctgtcctttgccccccaacatggtgcctgtttctcctgcctcttcatgcagagtggccagctcctggcccattcagctctgagtttgagctcctgggcggagatttttgttgccttgtaactgggattcctagatccagcctccaccctctgattgccctaaggaggttttggggttttgttttgttttgtttgtgttttcgtaggatggtggcagtgattttgaggaggggaagaggaaggaagatacaagcaagggaagtcacaggctgtggtgcctaggcagaccctggtttgaatcttggccttaccactttttgcatgtaagtggtaggggcagcagatagctcaggacatatcttgggtttttttgtttgtttttgttttgagacatagtctcgctctgttgcccaggctagagtgcaatggcacaatcttgactcactgcaacctccaccctcccgggttcaagtgattctcctgcctcagcctcccgagtagctgggattacaggcaccggccaccacacccagctaatttttgtatttttaatanngatggagtttcaccgtgtttgccaggctggtctcgaactcccgacctcaggtgatccacctgactcggcctcccaaagtgctgggattggccaggtgtggtggctcatgcctgtaatcctacactttgggaggccaaggcaggtggatcatttgaggtcngtagttcangaccagcctggcctatgtggtgaaaccgcatctctactacaagtacaaaaattagccggacatggtggcacacgcctgtaggcccagctactcaggaggctgagaatcacttgaccctgggaggcggaggttgcagtgagccgagatggcaccactgcactccagcctgggtaacagagcgagactctgtctta

SEQ ID NO: 261252 - DNA, 1405 bp, Homo sapiens
gatggagtatcactctgttgcccaggctggagtgtagtgactcgatctcagctcactgcaacctccacctcccaagttcaagtgattctcgtgcctcagcctcctgagtagctggaactacagatgtgcaccaccacacccggctaatttttgtatttttagtagagacggggtttcaccatgttggccaagctggtcttgacctcctgacctcaggtgatctgcccgcctcagcctcccaatgtgctgggattacaggcgtgagccaccgcgcctggcctgtacatataactcttaaaatgctgccctgaccctggggctcactttcaaagatgtccacactctgtaggccaggaccccacctgtcccgtacccttcctggcagccctgtccctgctacatcgcccttcagctacaccagctttctttgggtccctggaccacacctgataccttcccgcccagaagtgttatctctgtcctggcagttgctcaaccttttatggtccctaccaccaaggccatctgcttggttgacatacccaccccaactgtaattaaatcatccccggtgtctcctcactagacagctccacataagcacagctggtccttttagggctgtgtccccagcacctcccacaaaggaggatgcagttcatcaggatgggttggatgaacagcccattttacagatgaataaactgaggcacaggcaggtgcagaattttggcagcactgcacacctgtcctggctttgtcctcctccctggggaatgagcttggagcacccctctaggaactgggatgccagcctcttcccttgaccatcttggtccttgtcatgtgggccccagtaccaggggtggctttaatttggctgcccagggaggtggttcagggctgccaggacccctgaagtaggctctctgggctctgtcctttgccccccaacatggtgcctgtttctcctgcctcttcatgcagagtggccagctcctggcccattcagctctgagtttgagctcctgggcggagatttttgttgccttgtaactgggattcctagatccagcctccaccctctgattgccctaaggaggttttggggttttgttttgttttgtttgtgttttcgtaggatggtggcagtgattttgaggaggggaagaggaaggaagatacaagcaagggaagtcacaggctgtggtgcctaggcagaccctggtttgaatcttggccttaccactttttgcatgtaagtggtaggggcagcagatagctcaggacatatcttgggtttttttgtttgtttttgttttgagacatagtctcgctctgttgcagtgagccgagatggcaccactgcactccagcctgggtaacagagcgagactctgtctta

SEQ ID NO: 261253 - DNA, 462 bp, Homo sapiens
accagaaaagtgcacaccgagcctctctaaacccccgcagtgaacagcacggatggaggaggtgttccagagtcacccacgtggcccacaaatgcatgacctgccacagcgcatcctaatggcagcacggggcacctgctctcccaagaccccctgcacctgtcttgggcacagacatgtgcaagacgtgtgtgagcagagtccaggtggcagccatacacgccgcacagggatgggaggctgcccgggtgcaccaggatgcgtgtgatatcacacctgccgggggccaagtcacaggcggagacccagggataggagccgtggcccgcaacatcagaccagaaagtcacagccctgcagcagcagagaagccaccacatcagaggccacagcttgtgcagatcccatggcactgtttccagcccagtgagctgcgcctcttccagggtcgagggccggccg

SEQ ID NO: 261254 - DNA, 456 bp, Homo sapiens
aaaataatgtgggagagaaaaatccactcatgtttcatgtttcaattttctcctttgttttttcaaatctgtactccctttactattatgcttctcttttcctatatccagtacttctgtgctgacaaaacaaatggaatgaattgaagaattagttgatataaagtcaagacaccctttgggtgtctgcttccccttcgaccttctgccatgctgtgacattgcacaaaagccctcaccagaagccaagcagatgctgatgccatgcttcttgcactttccagcctgtagaaccatgagtttctaatctctcttctttataagtgacgaagccttaggttgtctgttacagcaacacagaacagactaagactattatctaatttcaatttctcgtctattaactaccaaaagtactttttttcctgctctgaaatatatatatatatatatgca

SEQ ID NO: 261255 - DNA, 92 bp, Homo sapiens
atgcaggcaaacattttgggggcttgcaaaggaacaaagccctgcatcctcgcaccgcccgccacccccgcggagtcctgccagcctggccc

SEQ ID NO: 261256 - DNA, 601 bp, Homo sapiens
ggtgacctgtcagagtcagcatggacacgtgggtgttcctccacagcgtctctcctgttcttagggttaaagggacattccccccagggaccttgcatgcaagttttctaggcaggtgagtctgcaagcttcatggcagccaggttgcacaggatctcattctctttccttcttccccagctttacctttataattctcttccattctccatgagtaacaagaaacgaacagatcccaggcgagttgtttattcccactttgttttacaatggactttgtgagatttataagggaacagaaattaaaatagaaaaaacagaaaaccaaatactatatattcttacttataagagggagctagacattgagtacacatgaacacaatgaaaggaacaatagacactggggactgtttgagggtagaggataagaggagggtgagtgtcaaaaaactacctatggagtactatgcttattacctgggtgacaaaataatctgtaaaccaaatcttcatgacatgcaacttacctatataacaaacccgtacatgtacccctgaacctaaaataaaagttttttaaattttcaaattaatgtac

SEQ ID NO: 261257 - DNA, 599 bp, Homo sapiens
catcagcccccgtgaagggccctctgcgatatcctcaccgccctgagtatgctcctcgtacatacgttgatcattgcacaactgcaattaggggttggcgcgtctgtctcctaccaagccagatgcgacagggattgggccttttgtctttgttttaaatctctggtgcccagatactgcctgcagagaaacaggcactcaggaacgtctagctgacaggtgggtgagtcggtaaacaacatctgcacagccctttccagtttacgaagccttttcccgtcctccatctcacaagcttcctctaaccagggcagcaaggaagggaggctcccggagcccgtccctgtccataggtgctgcctctgaaggcctgggagcttcagggccccttgtcttcacctaggcaggagctggggtcttcagggctcaccaaaagcagctgggacctcctttcagctgtaagccacccatttcctctgccaaaggctccctccccgcccatcccctggagagggtttgctgagtgcccaggtggtggccgggttggtagggcttgtggcggccctgccatcctgcccggagctgctgggatgcggccg

SEQ ID NO: 261258 - DNA, 845 bp, Homo sapiens
caatcatggcttactacagcctcagcctgatggtctcaagtaattcttctgcctcagcccgagtagctgggactgcaaatgtacaccaccgtgcctggctaattttagaatttttggtagaggaagggttttactgtgttgcctagactggtcttgaattgctggcctcaagtgatcctcctgcttcagcctcccaaagtgttgggattataggtgtatgctaccatcccctacttggatttttaaaattattaaaaattacattttaattttaacattttaatttcaagatagttgtagattcacatacaattataagaaataatatacagtgagatctcatgtaccctttaccaagtttccccaaatggtaacatcttacaaaactgtagtacagtattacaaccaggatattgacattgatacaagcaggatacaaaagcttctggaattcctcatggtgctcttttgtagcaaacccacttccctcctgcatgatctcaccccctgcctaacctcaggtaacctgtagtctcttccccatttctatggttttgtcatttcaagaatgttatataaattgaatcttacaatatgtaaccttttgggatcttctttttcactcaactttcactggagatttatcgaagttgttgtatgtatcagtagttgttctatttgataactgagaagtatttcacagtttgagtgtaccactttgtttaaccattcaccagttgaaggacacctagtttgtgtccagtttttgactattaaaaaataaagctctgcagtccgcagtccggcctgggcgacagagcgagactccgtctcaaaaaaaaaaa

SEQ ID NO: 261259 - DNA, 660 bp, Homo sapiens
cttctccatgctccagtcaagctcagcctggagataggtaaggggagtggaggagcagcctctcagatggggtgggaagggtttgtgtcttggtctctagaacctccccagccccaggccttctcctgaacacccactatgcactctgttggtgtcactctgaatggagaaagaattgactttcatcgttgtggtaccatgatgcacaaattgtatacttcacctctctggctgctcaaaataatctgtgtcttgcatgatagtggtcctaatttacagatgagaatacagcttagtcagagatggagctggccatgctttcccctgcaccagtggttctcagactcagctgctccttggaaacacctagggcccatgtcacccccagagattctcatgtacctgggactgggtgcagcctaggcatttaacggtttcaaaatttcccaggtggttccaacatacaaccatgtttggaaaataattgcccacacggcatggggttaacatgttattcagctggctgtgattcagctggctctccagtgctgtggaaacagacagatgctgggccacgcccatcaggtccaggtcactccattcgcccctctgaccttccgtgcccctcttggggccctcagcaggcatgtcctcacggta

SEQ ID NO: 261260 - DNA, 274 bp, Homo sapiens
ggagagagagagaaagaaagagagtgcgcgtgcaagagtgcacatacatgagctctctggtatctcttacgaaaacactaatcctatcagattcaggcatcacccacaggaccacatttaaccttaattacttctggctgtgattcagctggctctccagtgctgtggaaacagacagatgctgggccacgcccatcaggtccaggtcactccattcgcccctctgaccttccgtgcccctcttggggccctcagcaggcatgtcctcacggta

SEQ ID NO: 261261 - DNA, 173 bp, Homo sapiens
tcacacaactgaaatcacctaacaatgtgtttctcagaacatatcccttagttaagcggtgcatgactgaagttacattgtgaattttaccttatttttgcacagatggtatatcagatgctgtaagcccatcatactgatataaatggactgatataaattgtataatggta

SEQ ID NO: 261262 - DNA, 461 bp, Homo sapiens
tgagcagcttgatgtgctagaaagagctgtgaatttggacttggagcaattaggattctggttccagcttttttccagctacagctcgcgagtaacttagtttagcttctttgaccttggtttcctcatctgtaaaatgagagggtttgctcagatgatctttgacctaatgagtctacgaaaagtgaatgttggaagcacatgttcaccttctccaattaccagctgtgattatgtgactggaccaaatggcactaactgtcgaaaccttttaggctgaaggggaagcactaactgttgaaaccttttaggctgaaggggaagcattctgaaataggacaaggggcacctcgtgttgaaacctggagctggtcaaccctctgaggccaatgccgacctttgcatctgcctcccacgccctgcttgttttagctggaccaggagaaactaatgtcaagaca

SEQ ID NO: 261263 - DNA, 440 bp, Homo sapiens
agccccaattgagaagcttgaaagaggagggaatttaaagtgtctcttcacaaaggcacaagcaacaggcagcggacatttttatccaaagagactcttgtcaggaactgagtcagagaaacatcagtaagtctagatcccaattaaatttgccgctaactgggaccttagctctcatgtaatcctgcattcttattttatacacgagaagctagaggtgcagaggagttaagtgggtcgcccaaggaggtaggcacaggatccaaatagggacctcaaattgcatctccaagtttgtctaccctatttagccactgctattctaggttccttgatggagccccactcccacgcctactccacgttaatgttctgaaattgggatgtacttcataattatttcatgtaattctttttcttgtttattgtttttttcttta

SEQ ID NO: 261264 - DNA, 470 bp, Homo sapiens
tacttctgtatcctcagtacctgtaactcagcattacttagtacctagtagatgctcagtgattatttgttgaatgaatggatgaatgaatgaatgaaaaccatggcagaatggactggccctgacaacctctcagtatatactcgtgacatctaatgaaatgctaatttatcctatcacagtataatcgtgaaggtaaatgtgatagaaatgtcataggatgcattttgaagtcagctaaatacatgttttgtctcaccattaatcgactgtagccctttgaaaaccaagaatgctttcttatgaccatgaaataggtcatgtagaataggaaagttaatgacacaagtggttactaccccaaagtagtatttcgatacgaatagaattgaacataatacctagcatatagtggagactcaatgcatgttggtccatttaactgaattcaacggaattgccttgctagg

SEQ ID NO: 261265 - DNA, 222 bp, Homo sapiens
tcagggagtttctgcaaccagatttccagtgagatgaattaatcagctaatgctgcagagacactaaatgagatgacaggcagctcccacaaagcagatgctcaattaattgctgagtaatacttcattgtctggatgtactacagtttatgtatccatttacctactgaagaacatcttggctgcttccaagttttgacaattatgaataaaggtgccata

SEQ ID NO: 261266 - DNA, 425 bp, Homo sapiens
ctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacacctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaa

SEQ ID NO: 261267 - DNA, 211 bp, Homo sapiens
tcatgttaatctcaacgcccgatgtagaatttcatgtcaagtctcaatagttgattttctaaaccacacaccatctataggataatatccccattcattcattcattcattcattcattcatctgctatgggctaggcactgcccatgcctaaacaaagacataatcttacagagcttagagtctagcaacaccattaccaccaccatccc

SEQ ID NO: 261268 - DNA, 315 bp, Homo sapiens
cccgagcatggaggctcaagagtcctgttacagaattttctggggttcaaataccctctagaggtttccgttggttacttggtgtatgccttatgtaaatgaagggggtgaagtaaagttacaaaattatttacttggtgtatgccctatgtaaatggagaggatatttcctgtcatggctgaagtggttccatttgatttagttctaggaagtcagcatgaatcagccttatgttccctgcctccagaccctatcctcctgcctcagtaatattaatctcttacccagtacagtgaaggagatagtagaaacaa

SEQ ID NO: 261269 - DNA, 488 bp, Homo sapiens
tttgtagagatggagtttcaccgtgttagccaagatggtcttgatctcctgacctcgtgatccgcccgactcggcctcccaaagtgctgggattacaggcgtgagtcaccgctcctggccgctaagtgtgattttatttcatctatccaattgtgttttgtagaatttctgaagtctttgtagatggatgtattttgtcaattattttttagttttgcaaacttcccattcattatttcttatgattttgtccatctgctttaaactgcatttttctattgataaataattctgttaatatattgtctctttagttgcctctaatctgttgttaagcacatctactgagttcataatttaaactacattttatgttttttgaagttcattcattctttttataaatttcaattcaatgccgaaattttgctttattttatttatattcttgaccttacagttgtaaattaaacattttgacaatactg

SEQ ID NO: 261270 - DNA, 286 bp, Homo sapiens
atacaatccatcaatcttcttcaaactttcccagttttctctgtacttatttgtgtgttagttctatccaattgtatcctgagtgtgggttcatgtatcgaccatcatagtcaagatacagagcagttccatcaccaggagaatttgtcctgttatccttttatggccacaccctcttccgtcttgccccttccccacatctctaacccctgacaaccactcatctgttctccatttgtgtactttggtcatttcagaaatgttatataaatggggccaggcatgg

SEQ ID NO: 261271 - DNA, 462 bp, Homo sapiens
cagcactaattaccgtgggaatgctgtttttatatggagaaaataaatctaccttccaacttagttttatgaacaccacatacttttcacagttccacacctttgtgtatgctctgcctagaattctagctcttactactttcctatctaggaaacttacctcaacattcaacattcaacttaaagctttcctttacccttctacggtctgatttaatgctcctatagtaagcaccctgtgcacacttccatcataattcttctcacagtgaattaaaattgtgtgtttacttgtctttgtctcagtagacttgagagccaggaccgtatttttttccttgccttaaaatccccactgcctttcattgtacacgggcaaagtaataacctttcctgctgattctgtgttttagtgaccagacttcaactaaaaagtgttgcattaaagaaaaaattgaagtt

SEQ ID NO: 261272 - DNA, 540 bp, Homo sapiens
ttttctgaaccatgtgtttgtacacatgacctttttaaaaataagtgaatgaaggaatgaagtaggattatgagaaagagataagaacaaatgatctaaggggctgcccatctttttagtacccagtgaatattaatatataacaatagcagcaaaaattggaagagtagccccaggagggtagggagtcagcctttcctttgtcttttcctcaatttcatatattaaacaaaataatctgagaacgataaaacaatttgaaataaaaaatgtctccagatctcttaaaaggaagctggggcagctttctgtagcgcacttcccaaaaatgggctgatttacctcaagaggcagggattctagcctacatgggatacatacaggagaaaacaaaatcagaaaaagaaaagagatttaaatataaataaatgaaaataacaattctccctcattataaaggaaatcattctttttgtaataatttggatgacaaatattaagaaaaatctttaatttgccactcaaaacattgtggtttgt

SEQ ID NO: 261273 - DNA, 436 bp, Homo sapiens
agttttctcttagtctctatagttcattgactgggacctacatagcagctgatttttgcaggcacaacacaaacacatacatgattcctatagtgtggactctccctatgattcacaaaagcatatctgaatggaaaagtgtgaaaaagatatcaccaaaataattttaaaaatattttcaatagacaaaagagaagtaattcacttgtaaactttagaatgttagttaagattactcataccactaatgataataacatatagcatcaatgacactgattgagttccattgttctgccctaccaattcaataagtaccctatctatttattttattgtctacaacttcttggggcttagaaacaatacctcaaaatgaagacctcagaaatagcctcagaagttaagtttttctttgatcttctcccgtactcct

SEQ ID NO: 261274 - DNA, 438 bp, Homo sapiens
ttcaataaataattgttaaaattagaacaacgtgattgcgaggtgagatgttaaattgacatcttgaaaagcagaaacttagtatgggcatccaaacactagaatcagcaccggattacgaaacttccaagaaatgtaacgactgaaagtaatggacgagcctattgttctgtgcgagaaaggcgcaaggggagaagaaaagacacacacaccatacttttaaggactgtggaggattcaccaccacaccgggaagcaacagcctgggctccagagtcggacactacactcaccagactacagaggattctcatgaagtttcctcatggtctgggaccctagctcttatcgtaacaagttgtttggcatgagacccagtcacaagggcccttcccgactggactcaaggaacacaaaaaggtcaacttgtgtttgcga

SEQ ID NO: 261275 - DNA, 381 bp, Homo sapiens
aattggaaatagaatgggagcttcttttctgaatggatattaatgaaagcagggtaggagcttatagctgccagcaaagatcccgccaccaggagaggagaccccatctccttgagaaaggatctaacacaacaaaggaagagctgataagtgaaaagaaactgagacctgatgagaatgtataagcctctggatccaactttgcctaaagctgaatactacaagatttttcattacataaatcaataatttatgtttttgcttgcataatttgaattagattttctatgtcaagcatcaagcagttgaagttccaacgaatacaagcactcttccttattttttttaatttagttattctaaataggaacaaatcaaaga

SEQ ID NO: 261276 - DNA, 429 bp, Homo sapiens
aatcttgcacaggtgaatgctggcaatcgtgacaataggaaaagactacctagaggccaggcatgttcaacatggcagatccatcttccattttcattgccaaccacgtgtacagtaaggagcagacaacatgatgcctgccagatagaaaaactgtttgcataataaaagattagggtggggcagccagcttctttgagctaggtaaatgtcacacctggtccaaccaatctttgggctctatgtaaatcagatactgcctcctctagctagtctgtaaaacccgtgcatttcccaggggactggaaaacccacttgggcactcctctatctcttcaggagagagagttattttcttttctctttcttttgcctattaaacctccgctcttaacttcactccatgtgtgtctatgttcttgatttcct

SEQ ID NO: 261277 - DNA, 592 bp, Homo sapiens
gtgaattcctggagagtctgggttatggaccaccctaaggaaggtgtagaaatatgggtaaagcgtgatgaaaatgttatttgaaaatgacatagtgtctcctccatcaaagaatggtatcaagtccattcagccctttgagggctttgtaacatttcataagggttgttaattccttacctttaaaatgtgcatcagtgtcattcctgaatagcccttaaaagagtcagggtttagatgcttccaaaatacagtaacactacttctcagctactctacagaatttggatactgaggtgacccaccatctttgagatttgctttagtgcctccctccaaaaacacaacagatggaacctgagtgagttaacctcaggttctaacctgagttagagctgagagtcaattgagagtgggcaggatggagattataatgaagctggaatagacacacatgagggagccctaactggatcccagtggagacaactaaaatgttaaaattaaaaaaaaggcaatgagttcaaaagctggccctgctgagacaacatagaactgtcctcatagaagacaagatatcccttgagagatg

SEQ ID NO: 261278 - DNA, 518 bp, Homo sapiens
atagggacaatagtccctgctccctgctactttccatgcaaacacagagtgaaagaataagcggaattatatgaaaatgctttaagttggaggcaaggtggtcgaggaagattaagtactatcagtttccataagacacactagcatccaggaggaacgacagatatttgtgctgctactgctccatacagtgtgaattctgccaagtcagcaacagtgactccataacaacagacagccgtgtcccagaatgtgctcttggcaataatgcccctcctacatgcacagcctgcttcttctcttgcttttcatttcttctctataagctccttggcacagacctctttttttcaacatttaacccttctctcctttctagtacctctgtattaagtgctaatactatcatcttcttccttgacactgctgtcaatggaaactgctaaaatgcaaatatagtggtcctactcctctgcctgaactcatcaatgcctcctatcccttgtccaatctgcagg

SEQ ID NO: 261279 - DNA, 247 bp, Homo sapiens
ctgaaggtcctgtcgcagaacacactggaactggggctgtgcaggaaacatgcccagacaggaggacagttcagtgacagcaggaaccgggactgccgtgggctccaggctttgaagcttgtgtggttctgggagtccgaattcaggagtgaggaaggggacttcgagacctccctcccttcagccaggggatgtttgtgggaggaggtcggcttcatgaagggcatttggttaactcaaaggatga

SEQ ID NO: 261280 - DNA, 491 bp, Homo sapiens
agtgatcctcttgccccagttgagtagctgggattacagatgtgcaccactatgcccaacttaattacagtcttaaaagaatatatactcagagcttagcaaattggtggataaattttacttttttctatttaatttttgaattttaaatgggtaagtgcatgaaattttcttacattctgtgtgtttttgcagtaaacttttgcatcttgttaattgagttggaataaaaaatgcatacaaacaaaactataactcttaatctggcatctaactgggtaattatagggatgtgtaattatacagtaacaaactgtaatctttttgcctagaaagccactgaagattaaagaggtcttatattggcccttggcattattgatagaccacaacagacaagccaaaaacctttgaaatattgttgaagcctggcaaaatttagccaggcaggtttggattgtttacacatgcatgcatgcattcattcatcc

SEQ ID NO: 261281 - DNA, 442 bp, Homo sapiens
ttccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatcttta

SEQ ID NO: 261282 - DNA, 420 bp, Homo sapiens
aaccacccactgaagattctccctgattccataccctcagaaactgtgtgaaatatcaaacgtttgctgttttaggctgctgagtttggaagtaatttgctatgcagcaatagataatgaatttacaacatatgtactgatttgttcaccattgtttttgaacgttagtcatccttcatgccattttctttattcctaaagaacatctttcaaaattttctttaatgaagatctgttcgttagaaactctgtttctgtttatttggaaatgttttcatttcacctttatggcaagagaccctacggcgatccccagtcattccagccttctagtgttcaatgctttgagtaatctctttcctttgaatactggcaggagctgcaacacacttttaaccaacagaatgtggcaaaagtggc

SEQ ID NO: 261283 - DNA, 699 bp, Homo sapiens
ctcaatcatgggccacgagaaaagaaagcacaggtgaagagggtcaatattcacaggcttgcagtgagagggcacagagaaagcagaagagggagagcagggtgaaataaatggagaggtgggagatcagtcttctcagatcggagaatcagtttcttcaagttgtaggaagctggaaaactggacaccccagggtattttttacaagagttgctgtgtacaatgtgcttagatcttcattaatgtttttgaagagctgcaagtcaaaaaggcaattcttgcttctatcatgcccctctgagtgtggctcatcccaggacggagccacagagtcacagctggccattgcttatgctccaactctaccttaaacactcttctttttttgtcctaggcaataagttgctttcccttcaaggacaaactcaaaggtgatttccttggagaagtttgcacagcattatcctacctgagtccaaagcaatagacttccctaatcactccagaagcacttttaaaatgacctcagttctaattcgtatcacagtctggcacattgtgtatgaggatacatttatccttgtcatatatctagcttggtcatgtttgtatccctagcatctagcaaggtgccttacatggtgcatatgaccaggacatattgcacagagtagaatgaattcagatgcagtctggtcc

SEQ ID NO: 261284 - DNA, 357 bp, Homo sapiens
  misc_feature (339)..(339): n is a, c, g, or t
  misc_feature (345)..(345): n is a, c, g, or t
actgggtcccgcgcaggcgtccccgggaccgcagagcaaactttctggactatctgaggacacttgtccagcgagccccactgctcggggaggaggagccacggccggggacagatttttaaagtcttcttctaggggtttccagcagagccaaatgttagaaaaatctttccgctcctctgaagagtgaagtgagcaaatacaacccagcagtaggttattgaagacagcagccccaggttttggaaggtgacaatgaaatgtgaagaagttacatttctcaaacttgaaagttagtgacggcttacccaatttttaatgaaaattaaatatgacttnagaagncattggatttat

SEQ ID NO: 261285 - DNA, 314 bp, Homo sapiens
  misc_feature (137)..(137): n is a, c, g, or t
  misc_feature (246)..(246): n is a, c, g, or t
  misc_feature (255)..(255): n is a, c, g, or t
actgggtcccgcgcaggcgtccccgggaccgcagagcaaactttctggactatctgaggacacttgtccagcgagccccactgctcggggaggaggagccacggccggggacagagtgatacacttgggtgttgaangacatttttgaaatcatgagaactcaatgtttgactatgaatgtttcgttataactgcctggaaggttagcgtcaaagaagttgagtgaaattctagagaatccaagancaagttaantcctcagtgtttgattagcagcattagtggaggcattggaagaaaattggatccactaa

SEQ ID NO: 261286 - DNA, 470 bp, Homo sapiens
tcactcaaggccaggagttctagaacagcctgggcaacatagcaagaacccatctctataaaaaataaaaaacaaaaaaaatcagccagacacagtggtacatgccaggaggggggtagctactcaggaggctgaagagtggggatcacttgaacccaagagtttgaggttgcaatgagctatgactgtaccaccgcacttcagcctgggagaaagagcaagaccttgcttttaaaaattagaatttttttttttaatgatagtattgcaatgtagcggaactactttttaaaacatactattttaaagaaaatgtttactttttctttttctttttgggacaggatcttgctgcgttgcccaggctgaatgtgaactccttggctcaagctatcccccagcctcaatctcctgagtagctaggactacaagcatgtgcccaccacacttagctaaaattttctttcaat

SEQ ID NO: 261287 - DNA, 703 bp, Homo sapiens
gaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctccc

SEQ ID NO: 261288 - DNA, 442 bp, Homo sapiens
aagacctggattgtagcttttgaaaattctgttgtatttttgaaattttatcatacatttccttatgtaaataatctatttatatttataaccactttaaaaaatttttgtctaccaattgagtcaagtgtttaaagatagcaattgtatcttgtgctttatttgtatttctttcacacagcacagtattggtcaaaacatagtgactcaaattattaaagagtttgcattgattgttttactttttacttctaactcaaataccaatataattcaaaattattttctgaagtttcctgtagatcttatatattttccatttcagtgagttccctggattgaagaatgccaattatctgaattccactgagttctactttgatattagtagctgaaaatctgttttgtacattttttagctttattaaaactcactatcttg

SEQ ID NO: 261289 - DNA, 394 bp, Homo sapiens
tcagacgtctaggctcaagcaatcctcccatctcaacttcccaagcagctaggactataggtacatgccaccatacccagcagcagagacaacttacaatgtcaacaatgcctttggcccaggaacctgctaatgaacgtacgctgcagtggtggttcagggagttttgtaaaggagaggagagccttgaagatgaggagcatagtggtcggccattggaagttgacaatgactaattgagagcaatcctggaagctgatcctcttacaactacacgagaggttattgaggaactcaacatagaccattctatgatcttttggcatttaaagcaaattggaaaggtgaaaaagcttgataagtgcatgcctcatgagctgactgaatatcaaaa

SEQ ID NO: 261290 - DNA, 346 bp, Homo sapiens
gaatggggttctgagggatgcggcatatggctcagaagagaaaggagtgggtaggcagggagctcccaaccttagggacgtctttgactgggagggcgttgtgaaaggaaaggagaatctcaaggctttcctgtgacaaaagaatgctcacacctagcgggagatccctgaggaaagtggaccttgttaacgaagtggatctgccttttcgggtcatctcgcctgcccggcccaccttctcctcctgaccatgcctcttgtacacattctctggaaagcgctgtgcaaaaggcttatcctctctcccagagtttctccccgagaaacatgagggctacaaggctta

SEQ ID NO: 261291 - DNA, 486 bp, Homo sapiens
gcattatgctaattgaaaagaagccagattcaaaatgctgcgtgatgccatttatagaacattctggaacagtcagaatgctcgtggttgcaaggagttgagaggaggtggagggtctgactgcgcagaagcagcatgagggaactcttaggggcagtagaactggttgtggtgactcaaatctatgcatttgtcaaaactcacaaaattgcccatcaaaagggtgagatttacagtatgtacattaaaacaactttttaaaaaatgaaattttgaaaagatcatgaccattggacagatctgtgataatattttaatgctacctgttattacctgtaagatcttggagaagaaatgtaaccttctgaggttcagtttcctcttctgtaaaatagggataatacttctccgttgttcagaattcttttagttgcaaatgacagacactcaactccaatagctttaataaaaaaaaaaaagagagtc

SEQ ID NO: 261292 - DNA, 380 bp, Homo sapiens
gtataatgacatgaatccactagtgtagtatcatacagagtgtgttcacatgaatttagaggatttctaaatcctctgtgctctgcctgcttatcccttctgccctcctgcccccaacccctggtaaccacttatgttttttactatctccatagttttgccatttccagaatatcatatctttggaatcatatagtagtagcctttttagattgttcttaatatgcatttaagtttcctccatatcttttcatggctaactttttagcattgaaaaattcgttgtgtataccacagcttttttaatccattcacttactgaaagacgtagttgcttctaagttttggcaattatgaataaagctgctataaacactgta

SEQ ID NO: 261293 - DNA, 497 bp, Homo sapiens
ttttttaaagatgatttataaaggatgtgtacaggttagatttcgaggggactgttttctgtttaagaagtaactcattttgccgggtgcggtggctcatgcctgtactttgggaggctgaggtgggctggtctccaactcctgggcttaagtgatcttccctctgtggtggcctcccaaaatgttgggataacaggcgtgaaccactgtgcctggctgggttttcatacatgcaagtttacacatgtattttatcttacatgatagactgacattcacttagacaactctagaagctaaatttgtaatctgttcagataggtgttggcagctagtaacaactatcccatagagttatcccataggcatcaatattttaaccaaaatctggattggagaaacttagtcattatggggcctatctgttagcaaaatcgaatagtcagatatgctttgaccttaggttcctttagccaaaccttttttgtttttcccag

SEQ ID NO: 261294 - DNA, 419 bp, Homo sapiens
tttttagttttctatagagatcaggtcccactgtgctatgttgcccaggctggtctccaactcctgggcttaagtgatcttccctctgtggtggcctcccaaaatgttgggataacaggcgtgaaccactgtgcctggctgggttttcatacatgcaagtttacacatgtattttatcttacatgatagactgacattcacttagacaactctagaagctaaatttgtaatctgttcagataggtgttggcagctagtaacaactatcccatagagttatcccataggcatcaatattttaaccaaaatctggattggagaaacttagtcattatggggcctatctgttagcaaaatcgaatagtcagatatgctttgaccttaggttcctttagccaaaccttttttgtttttcccag

SEQ ID NO: 261295 - DNA, 418 bp, Homo sapiens
gattctggcttggcttttcatcttaaccttagattaattacttagtcgctctctgtctcaatttattcatctttaagataagacaaatggtagtacctaccttgttataaaatgagatattccctgaagagtgcttaatgcatactatgtattcagtagatgttacattattattttgatctacttctttttttacttttttatagaaataattcttgctgtgttgcccagactaatctagaactgggaaggaagtatgatcctcacctcagcctcccaaagtgctgggattacaggcgtgagccaccttgcccaatctactactcgtgtgtgtgtgtgtgtgtgtgtgtgtgtgtgtgtgtgtgtgtgtgtgtcagagtctcgctccagcctgagtgagactccatctaaaaaaaaa

SEQ ID NO: 261296 - DNA, 679 bp, Homo sapiens
tcacatgaaccttgggtaagttgctttgatccaattaaagagattatttatttgtgaatatgaagactaaaaaacttactgaagccagaaatttccaagcataattttgctacccaccagggcatacataaaaatatgcaaataaatcccattttaattcacttattgtatcaaaaataaatatgtcacctgtaacaatttaaaggaaggataaaatatactccaatgtcaagcaaacaactgaaaaattaaaatattaaatctgctaaatgatacacatacaaactgcaaacacaagtctttacccattttttatttcttcaaagaaaaaggttttgaatatactattgccctctacaatattttatattgtaatactctgagcaagagcattttctttttctatcagctcaaatctggtatgttttgattttccaaatataacaaagcagagttcttaattatatctgaagtcagtgtaaccagattttaaaagaaaacagacgcaagagaacattatatttttgaaagtttaggtataaaacatcaaatattaaccttactttttctataatttaaaaatatttataaaatattgatttttctcaatagagaaatttacacagctccataactttattctttttgaagtacataaggaaatttatattttttaaat

SEQ ID NO: 261297 - DNA, 441 bp, Homo sapiens
cttctataaacactaagaggcaggtttttatgtgaacataattttcagctcatttgagtaaatgccttagtagtgcaattaccagattgtatggtaagactatgtttagcttgcaagacattgccagactagtttccaaagtggctgtgccattttgcattcccaccggcagcgactgatcagtagtatttttgaaaagcttcccaggtaattctaatgtgcaccccagctagttgagaaaccactattcttttcttttcctgtttgaaaaaaatcactattccacatcattaatttaaagatggcagtatagcaagcatggtaattaagagatcagactctaaaaacagactgagttcaaaccctgtctctcttaattcctgactgtatgactttaagcaagttgtttaacttttttttttatatttttggagacaaggt

SEQ ID NO: 261298 - DNA, 198 bp, Homo sapiens
ctgggaaaagtgaccaggagtctcttattccagcttctgagactgctgtgttcttggtgagtctcccgcccgcggcttccaggcccaatctctccgttgttactgtgcaccaccaagcagagagggatggtaattatagatgctttaggagccgccatttgcttcacatggcaaggtgactcagaacattagatcagt

SEQ ID NO: 261299 - DNA, 241 bp, Homo sapiens
tatagctaatttgttagtcctactgaaaggagttggccagcatgctttatgtagacagtaagggaagggtcctggagaatctccaaccttccccacaagtgtttacactagatgttttgtgcagataaaggaatctgcacaggagggttgcccaaacatgcccccagcagactaatggccccttagtctgaggatggggtggagtctcttacaaataaggaacccagcctcatcagcctta

SEQ ID NO: 261300 - DNA, 538 bp, Homo sapiens
acatgcaccaaactatagatcttgggagctcagagtaacatcacgcaggataaatgccaaacattctacacctaggaatatcatattcaaacttcagaaaaaaacaaagacaaagagaaactcttgaaagaagccaaagaaagacaaacacctttgcctctacctataaaggagcaaagatgagaattacagtggacttctcatcagaaactatgcaagcaacaagagagtggagtaaaatatttaaagtgttgaaaacaaaacaaaacaaaacaaagaaacccaccaacctagacttctacatccagcaaaataatcctccaagagtgaagagaaaaatggagactttggcagacatacaaaaacaggaaattcatgaccagcagaaatgccctataagagatgctaagagagattcttcagaaagaaggaacagtacataggtcagaaatgcagatttacatgataaaaggaaaagtatcagaaaagacataaataaagataaaataaaatcttttatttttcttaatctaataaa

SEQ ID NO: 261301 - DNA, 368 bp, Homo sapiens
tatgagagctggttccgccctgctccaggagtggacatgtgactctggactggccaatcagaactcccacccctgcccggcccctgtgattggttcaggtgagccaatcagattcagggaaataatagaagggtgaggaagtgagggcggccttggccctgcagtggcctttattccccacagtggagggatggaaaccaaagaggtccgcgaagcccagacagcgggccaggcctggggccctgtgctcccggatccaaccaaccacgccccaaggtgtccagcttcagcttctggtgtttattgctgctgtttcttttcagttacccaagccaataaagttttctttctcttttttttaacctcca

SEQ ID NO: 261302 - DNA, 298 bp, Homo sapiens
atattaccctctcagagagtgctttgctgaccatctaacctaaagtagcccaaagttacttctagctcttactctgtttcatattctgcatagtactttttgttttttattttgaagtttttgtttcactttatccctaccccagaagctatacaatgacatacagcaagggtcctgagccctttccacttgtgaagagataatgattccagcttccaagagatgttgtagtgatttagaggtacccataaaacctcagcatcaaatccaataaaaaatgctgagcgctaaccagtgg

SEQ ID NO: 261303 - DNA, 717 bp, Homo sapiens
cgtatgtgttggcaggaacagcagcagcggcagcagcagcagaggcagcaggagcagagaaatggaaagagtgtgggttttaatgcatcactagctgctctcccaacctcatgaaaagtttcacctccctactcatctctatgtaggtctttctaaggaagaaagagggagatcaagattcttggggtctctttagaccaataccttccattattgaaaacagctttaattagaaggccttaaactcccttcccaattagctctgtgatgaattgtgcggtgtcaggaaagaaactgtatttagccttgcttggcatgcaggagttccatggtggtatttacagggaacactcctggcaaggttggcgatattgctaccaccatttgggtttgtttgctttttctcactggcatctgccattgtgctggcagaaataaatctgataatttgggattttaaagaaaaaggtggtttacctattatctgtgccctaactatatccttgcttgttccacggggttataaaacgtcaagcccagatcatgcatttgcccagtatcctaaaagataaatggtacttcactctgtgtagaatcaagcataaggtgctgagaaataagcaaattatatgggtcactaaaaattggcttccaatctgggaataaaatccagaattactaactctagtttctagattctagttgccaggcttcctt

SEQ ID NO: 261304 - DNA, 478 bp, Homo sapiens
gatataattaaggttactaaccttaaaatagagagattttcctgtattatctggacggccaaatctaatcacaggagtccttaaaagcagagaatgccctccagctggaggcaagaggaaggtggaataagaagtcacagaggttcgaatcaggagagagactcaacctgccatgtttagaactccttggaaagcatgaaaagaatgcaggtggcttctaggagcaaataccagtccttggctgacaaccagtaaggtaacaaagacctgagttctacaactgcaagaaactgaattcaagaattaaactgaatgagcttggaagcagatttctcctcagaggtgccaataaggaatactgctctgccaacacctggagttaggctttgttaaactttagcaaaagatccagtcatgcccactcaggcatctgaccaacagaaattgtggtacaataaatttgtgttgtcttaatcta

SEQ ID NO: 261305 - DNA, 1641 bp, Homo sapiens
tccttttttttttttttctgagatgggttctcactctgtcacccaggctggagttcagtggtgtgatcacagctcactgcagcctcagcctctccagagtcgggtgatcctctcgcctcagcctcctgaggagctgggaccacaggtgcacaccaccacacccaaccaatgttcttattttttgtagagataggatctatgttacccacgcttctctcaaattcccgacctcaagtgatccacccacctcagccttctaaagtgctgggattacaggtgtgagccactgcacgtggcctagggctcttcatttctgaaataacattccaccaatcatcctcattttagcctccatgtttagaagaacccagaccaacaatgtctgagacttttaggaactcaagtgtgaattgggcttattttctgcttttcctactgccggctatttggctttcttggatctgggatgtcagataccactcagccaccttcaaactctccaaaatatttttagtcctttttcttcttctcttctccctgccttcaatagaaatcccgctgctattattttagggagctttggggaaggaaaaaagttagatgccggaattcagtctgttatctaaacctgggagtcccccaagccacccttctgtctccttccagttctccaacctccgagaagataagaaacaccaagagatgatggggctcattgaaaaggacaaccagctcctccgacaggtgacagcctgggtgtcgttaaatgatcagccaggccactgttcttactgtaagtcccaacacagcaaagggcaagacggggctggagcgtcttcacagctgagccaggaccccttcggtagcatgccactcgacagatctctgcaccccacgtccacacagaaggctcctcgcaattgctgggtccagactggactggagggacccagcaagcgttcccagtccttttttttttttttttttttttgagacagagtcctgctccgtcaccaggctggagtgcagtggtgtgatctcagctcactgcaacctccgcctcctgggttcaagtgattctcctgcctcagtctcccgagtagctgggactaccagcacttgccatcatgcccagctaatttttgtatttttagtagagacagggtttcaccatgttggtcaggctggtctcaatctcttaacctcgtgatccgcccaccgcagcttcccaaagtgctgggattacaggcgtgagccactgcacctggccgccggccatcttttaggaaaaagtggatgggtgccacacatactcaggttgggcgaaatgaccccacctcttttttctccccggctgtccccagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccagggtatgcccagctgctgggacagaccctcaggaggaagggctggacagaccctcaggaggtatgc

SEQ ID NO: 261306 - DNA, 1939 bp, Homo sapiens
tccttttttttttttttctgagatgggttctcactctgtcacccaggctggagttcagtggtgtgatcacagctcactgcagcctcagcctctccagagtcgggtgatcctctcgcctcagcctcctgaggagctgggaccacaggtgcacaccaccacacccaaccaatgttcttattttttgtagagataggatctatgttacccacgcttctctcaaattcccgacctcaagtgatccacccacctcagccttctaaagtgctgggattacaggtgtgagccactgcacgtggcctagggctcttcatttctgaaataacattccaccaatcatcctcattttagcctccatgtttagaagaacccagaccaacaatgtctgagacttttaggaactcaagtgtgaattgggcttattttctgcttttcctactgccggctatttggctttcttggatctgggatgtcagataccactcagccaccttcaaactctccaaaatatttttagtcctttttcttcttctcttctccctgccttcaatagaaatcccgctgctattattttagggagctttggggaaggaaaaaagttagatgccggaattcagtctgttatctaaacctgggagtcccccaagccacccttctgtctccttccagttctccaacctccgagaagataagaaacaccaagagatgatggggctcattgaaaaggacaaccagctcctccgacaggtgacagcctgggtgtcgttaaatgatcagccaggccactgttcttactgtaagtcccaacacagcaaagggcaagacggggctggagcgtcttcacagctgagccaggaccccttcggtagcatgccactcgacagatctctgcaccccacgtccacacagaaggctcctcgcaattgctgggtccagactggactggagggacccagcaagcgttcccagtccttttttttttttttttttttttgagacagagtcctgctccgtcaccaggctggagtgcagtggtgtgatctcagctcactgcaacctccgcctcctgggttcaagtgattctcctgcctcagtctcccgagtagctgggactaccagcacttgccatcatgcccagctaatttttgtatttttagtagagacagggtttcaccatgttggtcaggctggtctcaatctcttaacctcgtgatccgcccaccgcagcttcccaaagtgctgggattacaggcgtgagccactgcacctggccgccggccatcttttaggaaaaagtggatgggtgccacacatactcaggttgggcgaaatgaccccacctcttttttctccccggctgtccccagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccagggtatgcccctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgtcccac

SEQ ID NO: 261307 - DNA, 406 bp, Homo sapiens
cttagaaagatggctcaggttgcagggctgaggctgatacggagaggccaagccggcatggggagtgccaacagcgtgtccaggccagggcacacggaagtggtcagtcttttttgtaaagctgtttctgcaagttttctgatgtgatccacagtaagaaagatattttgcattacatcctagtatatacacatgtccacctgcacacacaaagttagaacaaaatactcagtactagttcttatgaagagtgacgtgctggggtgtttctattctatgatatttgatttgttctagaagactgattttatggcccattaatggttagaatgcagtttcagaataccagcatccagcatagtcccatgaaacgaaggaaaagggttccttggggaagtaggtttag

SEQ ID NO: 261308 - DNA, 414 bp, Homo sapiens
tgagacagggtctcaatctatcacccaggctggagtgcagtggcatgatcatggctcactgcagcctcaaccccctgggctcaggtgatcctcccacctcagcttcgtgagtagctgggactataggtgcacaccgtcatgcctggctaatttttgtatatttttgtagagacgaggttccaccatgttgcccaggctggtctcaaacacctgggttcaagtgattcgcccacctcaacctcacaaagtgctaggattacaggcatgagccactgtgtctggccctaaatgaacatcttttaattctcaatagcacctgccattttgccatatgcgaatatactagacaagtgcttctgaatgcaaattaaagtaatattgaggtgccaagttctaccttgcaaataatttttt

SEQ ID NO: 261309 - DNA, 280 bp, Homo sapiens
gaatatgatactgtttaagagaaaatgaaaaggattacaagttttttatagtatttgactttgtgatgctctattatagcaatatttaatttagaaatctgagaaaataatttttgaaattttctacatctcttcacatttcgatgtatcatggcatgttaggttttaatgttggtgagtgaggcaggagaatggcgtgaacccgggaggcggagcctgcagtgagccgagatcgcgccactgcactccagcctgggcgacagagcgagactccggctca

SEQ ID NO: 261310 - DNA, 274 bp, Homo sapiens
gacagggaaaataaaggagttaaaagtatgcctgcagctctaaaatatgtcaaattagtgtattgattacttcaagctcaaagtactttggaaactgtagttccagaagtgactatctgacctgtcttttcctgcatatagcaagccataaaacttccatggagaaagatgccttccctgtgccgggacaagaaaataaccctatccccaggattggaaattgttgcttcagtagacctgtacaaataaactaaagtaactcttatctcccaac

SEQ ID NO: 261311 - DNA, 408 bp, Homo sapiens
ttctatcaaacatgtaggctgttaacagtgtttcagtattacaaataaacatattataagcctcaaactgccttaaaactgagaggagatttattggaggtttagtagaccagtctaccagaagttagacttctgggtactcagatttgtttgcttgtcttctgatggtctgtcaactccttatgggatgggactctgtccaattattttgggatccctactgcttaatttattgcctatgcacagaagaggcagacagtaatgatgcacttacagtgacatggagcctttgttatgggcgctctcaaagccctttatgcttgtaatgtttaattatcataactgaaaaatacataccattttaaactttatttaaccgacgagaaactaagttatggagagaaagtt

SEQ ID NO: 261312 - DNA, 206 bp, Homo sapiens
gagccagcaacaggattattctcatagaaaatggaccattgacggctcagtcgttaaagccaattcagacgaatcatgtcttcttccaagtgcacaactatccctaatgtgtaactaatacatatttgtgaaataacttattactgaaaattaggttttagtaatttgtagttatcaaaataaattcagtttgaacaaatggaata

SEQ ID NO: 261313 - DNA, 436 bp, Homo sapiens
ctgaaatgaatatagccaaagaggacgtggtctttcagcacctcaagctaaaaaatgctgcagaggaacttcctgtattaagtacagatggggtttcaccatgttcgccaggatggtctcgatctcctgacctcgtgatctgtccacctctgcctcccaaagtgctgggattacaggtgtgagccaccactcccagcctttgtcatcatttcagatagggtgaaggaatggtttaagtcgcctccaaggtatcttgttgggggtgaggggtacagaggggtcttactgaatggtgatgaaaaaggggacacaagcgaaaaatcaacattggagaaaagataactaaaccctgggaagcttaaggaacaaagtgtaacaaaacaacatggattgttttataaaatactttgagatatccaggattaaaagtatgata

SEQ ID NO: 261314 - DNA, 665 bp, Homo sapiens
acagaatctatgtgcgaagtaggtttccttttgagaatatgaaagtaatacatgagaaataagaaaaattggtctaagtcagaaacattgaaaaacaaaataaaacaaatcattcagtttaatcagccaaagacaatcactgttaacaccgaaatacatttctctaaccaccttttttctcctgcatacatatatgtttatatatattacacccagtataaataagcatttaaaaaaccacagtctttaaggagatttgcttttatgttgtttgtttttgtggctttagagaatataatcttgactacaataatttcaagtatccacatatatgtatctagaataagaaaggttttgctttttttttttttttttagatggagtcttgctctgttgccaggctggagtgcagtggcgcaatctcagctcaccgcaaactccgcctcctgggttcaagtgattcttctgcctcagcctcctgagtagctgggattacaggtgcgtaccaccacacccaactaatttttatatttttggtagagacggggtttcaccttgttggcctcgatctcctgacctcgtgatctgcccaccttggcctcccaaagtgctgggattacaggcatgagccactgtgccctgccttgctttctatttttaaaggt

SEQ ID NO: 261315 - DNA, 375 bp, Homo sapiens
aagtttatcaataatttttttttttgctaagtagtattccactgtatgaatatatgacaatttgtttattcattcgtctattggttgacattttggttgtttttggtttttggctattgcaaataaaactattaatttgtgcatacaagtctttgtgtgggtctatgctttcttttctggtaaacacctattaatagaagtggaatgaccgggtcacatgtcaggtatatatttaattttttagtaaattgttttccaagccaggcacagtggctcatgcctgtaatcccagaactttgggaggctgaggtaggaggaacacttgaggccagaagtccaagaccagcctaggcactatagcaagaccccatctct

SEQ ID NO: 261316 - DNA, 521 bp, Homo sapiens
tgttccaggccctgggcaggtattattttaattagttctcacaataatccaataagggagatactaatttactcagatgagaaagctgaggctcagagaggttaatgaacttagccaaggctcactgttaataaatagcaaaaggaaaataaattccatatctgcttgagatagaggccttgctcctaatagctgcagcctgtcagggcctggcagcagtaacctctcctttcctcttcccaccattcccctgcactgctttctgtaccacatctcttttcagagtgatgttgccccaattgcggaggccactgtgctgtttatccagtgaaagctgtagcacagccaacccaaagcgtccccagtgaaaacaacctggctccttacagcacttccagcctcagagcagtatttgaaaaatatcatgaatagcaaacacagcagtctgtctgtggcttttatatgtgtatatggtgtgtgtgtatgtcccttctcttgagcaaaataacttttagaattat

SEQ ID NO: 261317 - DNA, 1098 bp, Homo sapiens
gcacctgtaatcccagccactcaggaggttgaggcaggagaatcacttgaacccgggaggcagaggttgcagtgagccgagatcacgccattgcactccagactgggggacaagagcgagactccgtctcaaaaaacaaaaacaaaaacaaaaataaacctagcagtcagccttggttagtgagattatgaggcatttaaatttattttttgttcttttgtaaattctgaagtgaaagtctttagtaaaagttttaaaggagttctctttaaaatgtgttgaaatataataaacacagaaaagtacacatcagtgtactcctcaatgaatttttaaaaggccaggcacaatggctcgcacccataatctcagcactttgggaggccaaggcgggtggatcatgaggtcaggagatcgagaccatcctggctaacacagtgaaacctcgtctctactaaaaatacaaaaaattagccgagcgtggtggcgggcacctgtagtcccagctacttgggaggctgaggcaggagatggcgtgaactcgggaggtggagcttgcagtgagccgagatcatgccgctgcactccagcctgggcaacagagtgagactccgtctcaaaaaaaacagacaacaaaactgagcacaaccatgtagaccctgatgaattatagaacattttagcacctagaacccccttttacttcctaacactttccctgccaatggcaacactatcctcattaaggagaaggttttatttttattttttaacttttattttcaggggtacatgtgcaggtttgttatatcgtaaactcatgtaggccgggcgcggtggctcatgcctgtaatcccagcactttgggaggccgaggcgggtggatcttgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtctggcctgggcgacaga

SEQ ID NO: 261318 - DNA, 192 bp, Homo sapiens
ccaacatcttttattaatagcaactcttaaaaatttccatagcacactgctcagacacactccaaacatgcaaaatcaggtaccatacaagggcttgttcccccaaacctttggagatgacggggcaatggcttaatcatgacagtgtggggaacggtgtggacaccacacttatgaaagaacatcgctggg

SEQ ID NO: 261319 - DNA, 339 bp, Homo sapiens
tccttcaatagtttggctgccttcatctgggtgaaaagtttatattcccgatacagaaaacagccaagtctgatgggccagcttataatttggggtgatatcaattctctcacacttctacatgaagcctaaaatattatagctggcaaagaggcctagccaggtcattatagatgccttctttcactactcatctcacattccctttgactcatctaagcacttcaactctacagtgttctttatttgatgacatgatatgagttttagtagtgtgtgtgtgtgtgtgtgtgtgtgtctgtgtgtctgtgtgtctgtgttgtaacattttcactaaaa

SEQ ID NO: 261320 - DNA, 2376 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 261321 - DNA, 2407 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 261322 - DNA, 2312 bp, Homo sapiens
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 261323 - DNA, 320 bp, Homo sapiens
gaaggtatttcatccataatcctttatatccttttcccaacgtagacaagggcattccatgctcactgcctccgggagaggagaactcggcagaatacagttggcagggtaagtgcccaggaaagctttgttatgaaaagggatagttacttgccagggtgtggctaaggcccataagctacccacaccggcacctgtggagacctccttgattctgcctggctttgggctgcgggttcataaaggtcaccaggtccagttgggttggagagcccgccgtgtgccagctctgtgctgctccttcgcatgcagtaccggac

SEQ ID NO: 261324 - DNA, 475 bp, Homo sapiens
gagaagaaaaatcttgcttaattaattgcaatattaaattgaaatatattttagcttccttagacagtcctgaaagagatttgcataactggggtcttcccttggttccagtggaggggaaatatttcagttcacttacttggggctataaaagtttgttcttcctttccctgaagcaagaattgtgaacataaagtcataaaacagtttcagtgttaatttttaaaacttctccatatttccaccctcatcagtggtaaataatgtgcctgatgtaaaatggaaaaagttgaaaatttccacttgtacattttgagcttttcagaggtactatatacactctggaaataataataaaagatactaaggcttatacagtgctttttgtttgaggaactcatataaacactaatgcattgatcctaacacagtgcttgattgtgactttaaaaggtcatgagttactgctgttaca

SEQ ID NO: 261325 - DNA, 384 bp, Homo sapiens
atgaggatttagggtccccgtctgctaatgccccagatttgcttgataacgttgtcgtcggaagcaagtccaggatgtgagatgggaaggagagtagatggactcatgatgaaaggacagaaatcaactgccatcttttcctgttctcccattgcagtggcagtgatcacagaggagagatgcctatgttcacctcttccacctggatggatgctgagctcttagaaattgactttccaggggatacagaggctcatgcctatagtcccagaactttgggaggccgaggtggaaggatggctagaggccaggagtttgaagctgcagtgagcttgagaccagcttgagactagaccctgtctctataaaaaatgtttaataaaa

SEQ ID NO: 261326 - DNA, 442 bp, Homo sapiens
ttaaaactagccttctggttcccagtctggtgttgaaaccactgtgccatattgaatcttgtataagttatttggagcttcagttggcttgatgggggctctctgtagtttggaaaatcaggcagattatatttccacacattgaaataaaaataaaagttttgtgcttaagatatattttaattcctcatctgaaatatctttatcttgaactttaaattcttttcatgtgaatatttcctatatcattacttattaaagattattctaaacccccaaatcatatttttcatgggcctctccatgcgatgaacatcctcaaaagagtcttgactctgccgagtacagtggctcaaacctgtaatcctggcactttgggaggctgagtcgggtggatcacttgaggtcatgagtttgagaccagcctggccaacatgatgaa

SEQ ID NO: 261327 - DNA, 373 bp, Homo sapiens
tagcttccctccagttaacactgtaatttggcatttgtcttaaaaacaattctgaactagatgaagatgttcataatatcaccttgtattcatataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcaggaggctgaggcaggagaatcgcttgaacccgggaggtggagatggcagtcagctgagatagcaccattgcactccagcctgggcaacagagtgagacttcgaatcaaatag

SEQ ID NO: 261328 - DNA, 661 bp, Homo sapiens
cccattatgtggatgagaaaacaagtcctgagtgattacatgactttctcaaggcagtcaccactcaccagtaagtggtgaagccaggattcaaacacaggtataattgcaaagcccatgttctttctaccacaccaagatgattcaagattatatggagttagagtcttcacagaggtaatcgagttgggtctctagattgaaccctaatccaaaatgactgctgcccttataaaaaggagaaatttggaccaagacaaacgaacacagggaagaacgtacagacaccaggagaaggtggccatctacaaaccaaggcacacctgaggctaccagaagctgacaaagaagcatggaacagattttgtcttacgggccatcagagggaaccaaccctgccaacatcttgattttggacttctggcctccagaaattcaagacagtacatttctgttgtttaagccacctagttgtttgtactttgtagtggcactaagggaaactaacacacagatgcgtgccaagatggtggtttcttttggttggcttcatatccgttagtgaccactcctggtgaggcactattctaagcctgaaagtccagtagttggaatctcgctgagagttataacccaaataaatattccaaggacaaacaag

SEQ ID NO: 261329 - DNA, 416 bp, Homo sapiens
ggtaggtagctctaaatccagatagagaatatgtgagattgagagacatggagaagacaggggagtttgaccagagtaagataaacggcaggcaaccaacaccacaaatgagaaaaggagagggagaagaatgaggattggaagtagactgaaaaacgaaaaaagactaacagagggtagtgtgagagtgtgtagaaaagagagtaggagaggagaaaataaagagaaatggttggcagaactgaaagttaagcaggaatatacttatcatctataagcatctgaagatgaggatgggtgcagtagctcacatctgtaatcccagcactttgggaggccaaggcaggagaatcacttaaagccagaagttcaagaccagcacaggtgacatagtgagtacctgtctctataaattc

SEQ ID NO: 261330 - DNA, 657 bp, Homo sapiens
cccatctgaatcgatgttggacatttgttgaaaatcaatcgtccatatatgtgtagatctatttctggactgtgtattctgtttcattgatctagtctacctttgtgccaatgctatacagttttgattactaaagattataagttttagaatcagctagtgtaaacagtgaaaatcactgagagttcagaagttaaagttgtactgcggtttcaaataaggtacttaatggtcctttttcatcattcagcatgaatatcccctacgtatctctgaaggttgattttgttctttattttaagaataaaataacgttgtgaacagcttgaacctgacaagttcacttgaaagcattgcacaggaagtggatttctcagcagccattggtggggccttctgatcccctgatagtgagcagctctgggaacagaactgacatgagtgtctgggaggggacatgggaaggatctgcatacaaattgaagatccaattcctataaattttctatacaattgtatattttaatatataattataattgattttaagtctgtctctggaaatataagctttaataatttacatcttcacttaatcacttatgaaatcattttataacccttaataaaattagatagtgtaacttgtcaaaaaaa

SEQ ID NO: 261331 - DNA, 262 bp, Homo sapiens
tgtaggcggcaaactaagagagcaccctgtaacacatgcccactggggcttcaggagctgtaaacatccacccctagacactgccatggggttgaaaccccacagccttcctgtctgtatgctcccctagaggtttgagcagcggggcactgaagaagcgagccacacccccatcacatgccctgaaagggggccaagggaacctttctcgtttcactagtgctttgtcttgtcttggatgtcaaagtacttgtgtagcctc

SEQ ID NO: 261332 - DNA, 530 bp, Homo sapiens
cagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgcccaagaacccagatcgggctggtggggggaggggaagaggcgggaaggggagggtcgcacggaggtagctttgcagtgagcagtcgaccccgccgccccccggcacagctggaccggctcctccagccgcggctcagactcgcccctggattccgggttagcttcggtgccaggaccgcggcccgggcttggattcccgagactccgcgtaccagcctcgcgggagccccggcacctttgtatgagcacgagaggattctgcctccgcgcagcagcccgggaagcaggagccgaagcgcgggccgtggagcaaggcgggaaccggaggcggcggcggcggcggccaggggcgcacggtgcca

SEQ ID NO: 261333 - DNA, 365 bp, Homo sapiens
aggtcgcgggttcgatccccgtactggccaagtattctctgtggcttttatcaccagaatggatagtaacccagacatctatctaaacgtgtacctgtgtgtttctccaggcttaactttgccccgagaaaacggatctgtgaatttggtgcgccctcgcttactcgacagcggttaatttgaacggggacgtttctttccgctgcctccaaggcatacccacatcctacccgtaaaacaaaggggctataggcaccttacagtgacagaggtacgttacggttggaggcttttgtgatttttgtcctcctctgccccggggaaattttcttggagtaaaatactgaattatttgattacttcca

SEQ ID NO: 261334 - DNA, 2892 bp, Homo sapiens
tacggctagtcgagcccgggattatctcggccgaggcagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261335 - DNA, 2760 bp, Homo sapiens
tacggctagtcgagcccgggattatctcggccgaggcagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261336 - DNA, 2816 bp, Homo sapiens
tacggctagtcgagcccgggattatctcggccgaggcagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261337 - DNA, 2830 bp, Homo sapiens
tacggctagtcgagcccgggattatctcggccgaggcagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtgaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaaagtttgaacaactgactcttgatggacacaaccttccttctctcgtctgtgtgataacaggcaaagggcctctgagggagtattatagccgcctcatccaccagaagcacttccagcacatccaggtctgcaccccctggctggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261338 - DNA, 2233 bp, Homo sapiens
tacggctagtcgagcccgggattatctcggccgaggcagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcaactccaaaccccatgatgagctcttgcagaacaacagaattcagattgtggggttgacagaacttcagagtcttgcagttgggccccgagttttccagtacggagtcaaagttgtacttcaggctatgtacttgctgtggaagttgatgtggagggagccaggtgcctatatctttctccagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtacgagaagttctttgggcgcctgtcccacctgaacctgtgtgttaccaatgctatgcgagaagacctggcggataactggcacatcagggctgtgaccgtctacgacaagcccgcatctttctttaaagagacacctctggacctgcagcaccggctcttcatgaagctgggcagcatgcactctccgttcagggcccgctcagaacctgaggacccagtcacggagcggtcggccttcacggagcgggatgctgggagcgggctggtgacgcgtctccgtgagcggccagccctgctggtcagcagcacgagctggacagaggacgaagacttctccatcctgctggcagctttagaaactttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261339 - DNA, 1754 bp, Homo sapiens
gggcgacagataatcgaacatctagtagctcgtctctctgtgcttcctcctcagtgctgcctcgtctgtgctgtcccagcacagaggaggccgaggactaccccctgcttctagggtcggcggacctgggtgtctgtctgcacacgtcctccagtggcctggacctgcccatgaaggtggtggacatgtttgggtgctgtttgcctgtgtgtgctgtgaacttcaagtgtttacatgagctggtgaaacatgaagaaaatggcctggtctttgaggactcagaggaactggcagctcagctgcagatgcttttctcaaactttcctgatcctgcgggcaagctaaaccaagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtccgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctgcaaagatacagaaattagccaggcatgatggcgagtgcctgtaatcccagctacttgggaggctgaggtgggagaattgcttgagcccaggaggtggaggttgcagtgagctggattgtgccactgcactccagcctgagtgacagggtgagactaagtctca

SEQ ID NO: 261340 - DNA, 307 bp, Homo sapiens
tcttaaagccttatagtgtcatggctaagagctagggcttggtaatctggcctgttgccagttcttttactagctctgtgatcttgggcaacttagcccctgagtttcatctgtaaaatgcagttaaaaatagttcctacctcatgggtttattatgtattatacatactaagtaccgtaaaacaatgcatggaaaactgcttggcatgatgcacatgctcaaagttagctaatgttaatatgaatcctcagcggaagaaggggtagttggggaggtgtttttgttttaggagacagggtctcactc

SEQ ID NO: 261341 - DNA, 467 bp, Homo sapiens
ataaataaataaataattttacttaatgaagaaaatgtatatataaattttttgatggggtgttgcccaggctggagtgtagtggcgcaatctcagctcactgcaacctctacctcctgggttcaagtgattctcctgtctcagcctcccgagtagctgagattaaaggtgcctgccactgtgcctggctaatttttgtatttttagtagagacagggtttcactatgttggccaggctggtctcgaactcctgaccttaagtcatccacccactctgcctcccaaagtgctgggattacttgcatgagccagtgtgcccggcctaaaaaatattttcagtgtgcagttgattgaatgtgcagatgcagaacccattgatatggagggctgagtgtctgaaataagcatatttaaactaaagcatagtgaaaataaaaaattttatatggtaagatataaataatat

SEQ ID NO: 261342 - DNA, 387 bp, Homo sapiens
ataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcg

SEQ ID NO: 261343 - DNA, 364 bp, Homo sapiens
gcccacttaactagtcagatgtgaaaatgtaaaaaaattaaatgacctgaaagctgaatgccggaaataacgttttccttaagcagctactaatcttatgccaggtgcaggctgtgacacccttcaatgaatgtcttcttagtgtgccctctggccactcaaaagttggaaatttcacagcaactttgggctgagtatttatatgagatgagacacttcaggctaggattgtcatcagctggcccttcacaggatgagaattaacaagcaacatttttggaactcttcaagtgttctgagtgcttggcaatcatttaccagttaatcctcctttgagggaggtcagtcctctgcttgaattttc

SEQ ID NO: 261344 - DNA, 467 bp, Homo sapiens
tgtgaaaacctgagggcccagcgtgaggatgttccaggagagtggagttgatggtgcgcaggggattagcttgctctggttatagagacatgattaaaatctatttgatttcagtacttaactggcaaatctgatgcaacttctggaaaattcctagatggctttaggcatatttaaaagaagccatatttttccttttaaaaatagatatgcaccaaaatattttattttcatctaatcccgctttaacaaccagaatccccttaaaagcaattccaaactaaaagatgtaaatccatttcctatgtgcatttgttctttggtaccatcagggttaatgtttgcatcctctgtgctgaaattaaggatgttgggaaagaagtgtcattgctttgcctactaaatgtcacttgagtatgcttagctttcatccataagagagctgaacttcccctgtaaaaaaaaaa

SEQ ID NO: 261345 - DNA, 264 bp, Homo sapiens
gtagcactcccatttcttttgtaaaatatactaaatatatatatatatataaacctttttgtagtttgttttaaaacgttaccaattctctatacattcaaaaataaaattaaataaacaagtatgagaaaaaatgcaaattgaatgcaaacagaaaccaatgaactgtatttcaaatgaatagcccaactacatggaagaaaaagaaaagaattaatccaagtaacatttgaacccaatactttggctaaatatcctcagtca

SEQ ID NO: 261346 - DNA, 714 bp, Homo sapiens
cagcaatcttgattagtgagttcatgagtaagaattctgaaagtggaagaaagtgggttgggtaccccaggtagagagaccaatatatacagagacataaagatgggagaaaacagaaactctactatcagattaggtgtttggtaggagataagactggaaaggggagcagggaccagcagaagagccttatgggccatctccggagtttcgcccattctgagttactcttaatgcattttaggcaggagcgtcaacatgattgactttctgggttgggagctggactcagagagcagtgtggaaagtgagctttgagagttgatctaggagacaggaagaccagttagcccaaggtcagcaattgcaacccatgggtcaagtctgacccatcatctgtttttgtgtgaccattaactaagaatggtttttatatttttaagtggatgaaaaaaaggggaaacaatattttttgacacataaagattatacatctataaataaagtttgattggaaaatgctaccattatccttcatttattatgtatggcactaccacacttgagttgaatatggtcctcaaagcctaaaatatctactatctgtccctttacagaaaagtgtaccaactcctcaggaggctgtttagttcaagtaagaagtcaagagggcttgaataatgacagattcaaatatgtatttaaagaaggtaa

SEQ ID NO: 261347 - DNA, 405 bp, Homo sapiens
ggctctcatgatactggctgacaccataaagtcagtggtattccctgaggttctgctagctgttctgtctcgcttatgttaccctggcatttcagggagtccacagttccaaagaagtcttggaagcaggaaaatagtctataagatcatacatttgcaatttaatttttaaataactaagtttcaaatactacacagttacatggggatgttcacaatataatatccagttacaaaatgtaaaactttataaagtttatttttatctttattagtgtgctgcccattttatatatatgtatttgtgtgtacacgtgtgtgtgtgtgtgtgtgtgtgtgagcagaggagaactagacagaaataaatccaaacgttaatggtgttaactattttttataagataa

SEQ ID NO: 261348 - DNA, 1332 bp, Homo sapiens
  misc_feature (1)..(1): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (13)..(14): n is a, c, g, or t
  misc_feature (16)..(18): n is a, c, g, or t
  misc_feature (20)..(20): n is a, c, g, or t
  misc_feature (23)..(23): n is a, c, g, or t
nggctnccngngnncnnncnggngtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaagggttgaaaagaggcgtctgcgtgaagatcaatcatttcccggaggacacggactacgaccacgacagcgcggagtatctactccgagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggc

SEQ ID NO: 261349 - DNA, 947 bp, Homo sapiens
taccatggggcatacctaaggctgattgcctggtgaatgaggaagtctttcgggctagaggataattaaagcatccagggcactgttgaggcaggtgaactgtgaattctttaacccatttcccagtcagtactcaacaagcagtcacctctccaattagagtataaaaaagttttcttccctgagaagattcagggtagtgaattttgttttgaatagcaattttagttagcgtaatgatttttttactttaaaaatgaaattttgaaatagtacagaaaagttgaaagaatcatacagtggtatagtcatatgcccaccatacaaattttattatatttgtattattacatatccgtccctccatcctttcatcaacccatattcttttctgttgttcggtttcaaagtaaattgcagacttcaatacacttcaccccaaaacacttcagggaacttatcattgatgataattcaatacttaagtttgttttaagtgaaaggcacacattacaaatatacaatttaatgaattttgagaaatgaatatacatctataacccccaattcctatcaagatatagaacactagttcacccctgagagtaacatgtatttttacatgcagtcaatcccacatctcccaaaggaaactactgtaatgatctttttaaaccataggttagtgttatctgttatagaacttcatataaatgtaatcacacagtatctgtagtattttgtgtacattttactttactcagaaagatatttttgagattcattcgcctcgtgttaacagaagtagattcctttgtattccagagtagtattctattgtgtagatataccaacatttgtttatccagtctgttgattgatacctgtgctatttccagtgtttgacaatgaataaagctactataaatatcgttgcacatatctta

SEQ ID NO: 261350 - DNA, 354 bp, Homo sapiens
ccaaatcaaagaaagaaaattagagatgggcagctggaaatactggaagttatagattcactatttgggaactcttatatgaactccaggtgtgaccttgaccagcgaacacagcaagtctcagcctaagtaaatcagaatgtaggactggtgggctagatcacccttactcctgggtctgggccatgcagagtgggcacttaggtggtgaggtcactgtttataccagaataccccttatcgaatcataaaatcatcatcttggcagtttttgaccatgtcagtcttaaagattaatgtaaaactcaatgttagactttggagaccattaaaatatcagtgttagaactcatt

SEQ ID NO: 261351 - DNA, 547 bp, Homo sapiens
tctttgcaaatagttcctccaagattctgactggttctttttctgggaaatttaaggagaggattggcaggaaaaaccacagctctgtcactacagcaatggatcctgagaggccagctgattatctcactcttctacccgttctagagtcccttcacccttggctatcatctctgttggtttcggtggcttagctgctggggtgacctagaccctcatctttgatgggtctgagaccctggttgtcacgtccttctcaggctgcaaccatggcacttggcaatttgccatcaaaattggtaaagggagtacaaggagattctcctggagatgtcccgggtgccaaatattatatacctttcctggcactattgtatatcagcagttttacttcctcttagtgatcagagtcaatgacccctgctgaatccccaatatgacacattcccagaatggtgactccttttttcttgtctcttataacaagaaacctaaagtaattaggcagtagctataaaatttaatgggactggccgggcgcagtggg

SEQ ID NO: 261352 - DNA, 238 bp, Homo sapiens
atgcattgatcaggctttgcaaataattacatttgcaaatgagaaagacagtcctttgccagacccctgtatcctgatttgcaattgtgcgctgtatcccttactagatggctacatcccccaggggagagactatgccttaatatgcagaatatctaaatttttttggaatcgtggtgggaaaaaattaagaagtttggaaaaaatggaaatataacatctttttgcactcttcaca

SEQ ID NO: 261353 - DNA, 517 bp, Homo sapiens
cctcagatgacttcgggggcctgtgaggtgcctcactgcttccagggcagaacagggtctgggatctgcagagggttctagtgcctgctctgggagcagccctgggtgcagaaaatgcagggccagctcagtctaggaaatggggacatggagggagggccctccccagctttccacctgcccattttctcaccgccagctgactcagtgattgagacgagttcctgtctctggttttgttcggcacatcagagtctgcgactgagcctttggtctggagtttgagcaaactggagctgaaattgcctcgacagataccttggagcgctgacaccgcagcaccagccctgctgtggccaggaagggagggaggggactgcctttcctgtgtgtctgtgggtcacggccttgagttagagccccgggcctcctgccctgggacgtggaggaccttacacaggtgcctgaggaactaaatgttgatcaatgaaatatttataacaaataaaaaagtgga

SEQ ID NO: 261354 - DNA, 417 bp, Homo sapiens
cactggtcagagtcttgcaagaagtctctttgcctttgagtctcatcattttcatcttcaaaataggactgttgtaactaggacaagaggtgttgtgaaagcactttgtgaactgtagagcatcattctcctgtgagataataatagtgttttaagtggagtcggtactttttgagagttaaaggatatctcacagggcatggtagacgtactagggccaaggactgcctgaaacctgctcctgtgctgccacctgctggtgaagggacacaatgaccacccaagccctcaaagctttctgcaggggccaggcaggagccactggggcaagtgaaggcagggctgggaggacgcctgccactaaacccttgaggacatcggtgatgtccgcaataataaaaaactcttcatttttta

SEQ ID NO: 261355 - DNA, 333 bp, Homo sapiens
tgtttctgtgtagctttgtaggtggttgcttgtgaaagccaggtgggatatcactgtgtggccatcccacatgattctggtctgtggaattgccatgctttctggggacacatccaggagtcactggcactctggcctgtccggacagtgtgcttcattctggctgcccaggcttttgggtctttgtttgctctgctcctctggtgaaactgccccatgattgtgattaattgctgcacagaatgaagctggttttgtgtctgtgtgtgtgtgtgtgtgtgtgccgagcttctatttcatattgcaaatataaataaaggaaggcagtttacg

SEQ ID NO: 261356 - DNA, 733 bp, Homo sapiens
atccttgcattggaattcatgaaaactaggaaagaaattacttggcattattgaaatgtatacctgaatgttcaggaagtcagaattcaagaaggtcacgaaaaagatggagtgcgatcctgtagaatgagattctgaaagcagtgttaagtactcagggaagtccccacccaccccactttttttttgagacaaggtcttgctctgtcggccaggctcaagtgtagtggtgtgatcatggcacactgcagctttgacctcctgggctcaagtgatcctctcacatcggcctctcaagtagctgggactacaggcaagtgccaaccatgcttggtttattttttgatgttttgtaaagatagggtttcaccatgtggctcaagctggtctcgaactcctgggctcaagcaatctgcctgccttggcctcccaaagtgctgggattagaggtgtgagccaccaagcccggcctcactgggaaagtcttaaaagcatgctacttggtttaccattaggaatccttttggccacacaagatagaaaacaccagagaagagtggtttaaacagtatctgtctcacacatcaaaaatgtgcagaggagacagtccagggctgccatggactctgcaggatcaggaacctagctcctaccagtgtttctctactattgtctgtacatgaggtttcttcctcatggtccaagacagatactgaacactagccataatgtc

SEQ ID NO: 261357 - DNA, 432 bp, Homo sapiens
gatttttttcttttcaatgtggaagagttaaattatcttttcctattgtggttttgtttcagacagtattcataagaaaattctcttattctttttactaaatgactcacatattttgtttcaaatttaagtttttaatcccactgggatgaatttagtgtaaggcgtaagtacggatccacaatgtttcaatatggatatctgaatggtttaactgcttttattttattttatttatttatttattttgagatggagtctcgctctgacacccaggctggagtgcaatggtgtgatcttggctcactgcaacctccgcctcccgggttcaagcgattctcctgcctctgcctcccaagtagctgggattacaggcgcccaccaccacgccaggctagttttttgtatttttagtagagagggggtttcacc

SEQ ID NO: 261358 - DNA, 415 bp, Homo sapiens
agaaggtaagtagttgaaaagcacttatgttgtagctctcaaattatgaaagaattttatttaaaaagtttaaaactggggactcggtttattttagaaactatggcagataagaagataaccttttattcatttaatctaagacacaggtaaacactaatgtcatagggattttgtagataaactctattgtaatgtaaaccttttacaatttttagagagcattgacacagtttatcacattgcatctatgagaagggtcagcttaattatcgagtctttgcagttagtccagcagcaagagctctgagtttcttgaatccttacttcatactggtccatagaagtagcaacactatcaagactccagtggcaaagagaattctgagtgtagcgaggggtgggcagtccccaa

SEQ ID NO: 261359 - DNA, 635 bp, Homo sapiens
acaaaaaattatcaaggtggtgaaacaaagaaaattttttttcttttctgaaggacttttacgtctttattgtctttgctaagggtactaaggtgcattgtgactctgcagtcgggggcttagaagttaaagaactcgattacttgccagtcttattttttcagaggatggaggttgtcctataagcaaccatttgtgtgtgtgtgtgtgtgtgtgtgtgtgtgtgtgtgtgtggtgtgtgtgcatgtgtgtgtgggtattcccttctcaaaacacttgaagtgagaggctaaattatgacttaaaatcaaaattattatttgaagccatgggtatagaagtttaagagccacctggaattggagctttgttattggggggtgtgtgtgtgtgtgtgtgtgtgtgtgtgtgtgtgtgtgttgtgggggtcaaaattttggaattaaaatgacattgctatttaatattatctgcagcagtgtttgaattagctggaatattgttcatttccatagaaactggtcacaaatgagaaacaatattattcagttttgttaggaaaaactcaagagcttgtaattttgttaggccttgattataaatactggtcttaactaattcacgcaaatttcatc

SEQ ID NO: 261360 - DNA, 1344 bp, Homo sapiens
tggagtttaggacgtggctgtgagagtctctgacgggtgtaggtgtggaccccagcatctgaaggcagaattgttccctggttggtcatgcgtgttgggtggaaggtgaagcagcagatggtgagggaagccaggcgccctgtggagaatccttgctccagagcgctggccttcctgccaactgcatccccatgaagtgttccctgtagcctttccatgttctgtacactttatgggtgtgagctgcaggagaccagggaccgtcaggttgagattccctgtgttgccacaggacagtcattttgcaaaggccccgggcaggggagcagaggtgagccaccaacactgtggaaagcacacagacacgtttgctaatgagctggtttctttgtggagctttcatcaaggaggaagggggaagtttggcttttcttactgcttccggagagttctttacagggttgggttaaatgaggtcaaaggagcactctgtaggatcccaaggcattggattccatggctcgcaccagccctccttagttcctgaggcccagctccctggagggcacagccttctactttccaggctcctctgggaaccacgaggaagagaggaggcgggattgtcttgtccataaaaaaagaatagagtttctaccgcttagaacatttttctgcctcataaggcatttccagctgaattgacagttctctgtgataaatgtacttgagttttaggttaaaaattttttttcatcctatatgcattaatccagacatggatttatggttgggtagcccaaccctcccctgaagggaaaaaaaagaacaatttaaaaagtcaaaccattggctgggtgtggtggctcatgccaggtaatctcagcaatttgggaggcctggcgggaggattgcttaaggcccaggagtttgagactagcctgggcaacataacatagtgagactcctatctctacctacacaaaaaattaacaaaccaacccagtgctttgggaccctgtaatttgaaacaagctggtgaatgctagttatagctaccgttaggttagttgcctacacggagcccctctctgcgaatccgtgtgctgcaccacagctcaacaggcccgtctaccttgtaagatccccaaggggactgctgcagccctcagtgcctaagctgatacctgatctgctgggcatgggtctgctggcatgtcagtatcaccgtgggggcgggggtgggggacttgtcggaaatgcagattcaaggctccaacgcagaccttcttaccggaaccttgtgttgggggctgggatctgtatttaaaataagtgatagac

SEQ ID NO: 261361 - DNA, 578 bp, Homo sapiens
aaatagttcccaggtgagatgaagtagggaaagacatcccaggcctctgtagcgtatgtaatagtatatgcaaaggcaaggcgggccaaagcatgatattcatgagggttgtggggtatgtgattgcattagagcagagggagccaaggttgatcctaaagaaatagtttaaggttggatccttgtatgtcatgctaaggaattttacatattcatgtaggtaatgaatgaagagccactgagaggttcaaagtagaaaagtagtacgataagagtttttaattaattctggtaatgaagaatgaactggaaggaagaacttctggtgatggagagagtagagtggagagaattataattatccgagagagaaacaccaagatcctgaactaaatagtggtattgggaacaaggaggaagaatctccttggtagtatttcagaggcagagcataaactctacaaggcagcagcctacaaagggaggcaggaggtaggaacagcctaacccaggaggacgcaagggcatgcattatgtgtagagaatttaaaaacaacaataaaacttactaaaactca

SEQ ID NO: 261362 - DNA, 574 bp, Homo sapiens
atgctcacaaagccctggagcctagccagatgcatcacctcagtgcagggtgaaaacccccacatggcacaggctgtggcttcagaactgaaaatatttcactggcccttatgcatctctctgaagttcactagccatgatacaagccatgtggggctcaggagagccagcaattgctacagctttgcctcatctgggctggagctgaagcaggctaagaaggctaggatctggaactccacaagctagtctctggccaggcaggcagaacctgcttcacaaaggcccagttgattgagtactttctggaggctgggagtgggtccctctgctggctgtttgtgggattcacatttcctgatggggcccagggaagtttagcagtggctcagggtcacagaggagctagggttgaaatcaggcctgtctgattccagagttcatactttttttttttttcttttctttgagacagagtttcgcttgaacctggaggtggaggttgtggtgagccaagatcaagccattgcactctagcctgggcaacaagagccaaattctgtctaaaaaaaaa

SEQ ID NO: 261363 - DNA, 485 bp, Homo sapiens
aacaggaaagctcactttctccggggatattcaggccaacactaggaaaccacagccaagtcaggcagggcttggggcggaactgctgacacctccaccctagccaatccaaggtgcacgcctgcctcatgcagcccagcgtgactcccgccattggcacactgtgcccatcacaggctggagctcctttcctccaccgtcttcccaactcctgccaaccagaacttaactactcctttggattctgcttttcacttgttcttcatcagactatggaagcttagacttcataatttggctgagacttcaaaaatagttttaaagaaagctattcccaccctgctaaagtaattacatgattctgcccccttaaacacccaaagccctaatctgtgttctcaaaactctgatcttaatcgcttttttccagtcttatctccaactacttttcttcatgaatacttccttcataaacactgtacttt

SEQ ID NO: 261364 - DNA, 206 bp, Homo sapiens
catcccaggcagagctaaccacgttctcctttgtgcttttgctggccccacgtgaacgtctcaccgcatgtgtaagacttctgagcatctatgtactgatgtatttgtcttctcgccagactctgaactctttgaggacaggcgccatgtcttatttatttttgcacgtccagctcattggtcagggctgggcaggggcatatcat

SEQ ID NO: 261365 - DNA, 982 bp, Homo sapiens
  misc_feature (314)..(314): n is a, c, g, or t
tcattctgggagccgcagagagaaaggtaggatcttgttttgctgcaggctgaccttgtgaggtttaggtttaggtggggccatctggaagagtaagctctaccccttagaacagggcaggaggaggggaggactcttccattctgagatacaaataaaacccaccttataccatgaacattattttccaaaaaaccctgatttggactccatatggcagtcatatatattctttctggtaacataactttgcttggcctcatttcttgtgaacagtcgtggtcttattttgtttagagattgttcatgcaatngctgccttgggtaaccaacagagctgtaggacgttgtcagacaatgacgcattctgtgcccaatctcttctcctgaattcccaggattcacctccaagttaggaaggcagtggtatttttatttaagtagctaccctatgcaaagccatatctctccttaggactcagccagtttccccaggttctgctaaaggcgtattttggaattgtcaccacactatcctctgagccaccactcttctcgggaggttaaagtctgttcctggtacagctcttgaagccaacccctgcactcatcaggttgagttctcccccaaaaatgagttaacagagcaggtctgaggctgctatgcttagaaagacctgcaggcatggccgtcatctgggaacttggacttggggagggtttccaccttccccagaattgataagcgtggctcacagtacctaaacagacgatgtggtatatgttgaacttctgctttcccttctgggagtctggaattttggtatgtgccaggtagaggcagacaataaaagccttgggccctgagtctctaagaagtattcctggtagacagcatttaacacatggcatgacttgttgctggaagaattgaatatatgccatgtgaccccatggggaaaagactcttgggagctttcct

SEQ ID NO: 261366 - DNA, 426 bp, Homo sapiens
taatgagagtagtccgaggagaggcacttcaaaagcaaatctcctgaaatgacagacccatgttagtgctgagggactaaggagtggggaaggactgagtgagccaggagagtgagccaggaaaacaagcccctggacacctatgtgccttcaaagtctgctgtcttctttgccttgatcacctgagaaggactccacattcttacccagtgtgatctcctaggtgatattgactactcttctcaaaaccatcacttcaaggttcaggcggaactgtggggtaaggcctagctctttctttaatgttgtttcttcttgctaacgtttggaaatccttcttttccacctgctcatgagagaaattatcggtttctaagtttcttttcatttcccttcccacctaccgaaataaaaatacaacactgt

SEQ ID NO: 261367 - DNA, 659 bp, Homo sapiens
acattcaaagtctattcattgcaggaattatgactcctcttggacatcaccctacagacatcaggctcatcttagcagtaagcatcaattgctatttttgttaataatgatattctccccttcccttgttaatggaataaacaaagaagccttttggttcgaatttggtttggaataatttgagtggtctttaagagccactaattttcaaaaacaaccttaaaattatgccatttaacagtttctccatcacatgattgaaagaggagagagagatttatttttctaagtgacattttaacctactgggatatgaaggggagagagagagagagaaactggggtctcttaaatgtgtgaaaacaacaaagtctctttgagctttcacttttcattaaaatacagaattagaaagctcccaatttaaaaactaacaaatgtgccaaaagcaaaatccaagggccatagaggtcctcccatcataccagccagtgaccctcctggctgaggttcagaaatgaacagaaaacgccactcttctctaaaaacaattggtatcattttggtttccaagtaacattttcctgtacagctgcatcagatagaattctcagttaaataaatgactcacttaagaattaaaagcactggaaaaggcc

SEQ ID NO: 261368 - DNA, 307 bp, Homo sapiens
ctgcctcaatttgacactcaaatgatgcaaaaatcagtcctgaattatgcaaggtttaaccaaaataaaagagagaaataggcgaggcacggtggctcccgcctgtaatcccagcactttgggaggctgaggccggcagatcacctgaggtcagaagttcgaaaccagcctgaccaacatggagaaaccccgtccctactaaaaatacaaaaattagccaggagtggtggcgcatgcctgtaatcccagctactcaggctgaagcaggagaatcgcttgaacctgggagttggaggttgtagtgagc

SEQ ID NO: 261369 - DNA, 601 bp, Homo sapiens
ctcaactacagatcagcaccacatgccaggaccaaaatagggaaggaggcgacaaaaaaaaaaaaaaaaaaaagaaaagatgcaggtacaggtacagtattaataacttcaaactttattttcttagataaagcagattagagtaagtgtatgcatatactattcacacctgaatctaccacccctcatactcagctccatcatcctcataaaaagaaaaaaatattaaaagtttaattgctcacaatttaaatgaataataaattacattaaatcatcctcaataaacataattctataaatttttctttagtcccaagtatggtccagttagagaagaagggagaaaagggagtggagagtaggcaataaaaaagaaaatggtaaatagagaagagaaataaaggagagaaagggggaaagataatgagggaggtgaagaataacaaaaagaaagtcaaatatatcaaaacaattggaacgagtacaaactccttctttattgaatttgtaataatcttttaatttaaatgttaataataggggacatataacacttgaattttaaaaactattttaatttaaattttaagaaatttaa

SEQ ID NO: 261370 - DNA, 736 bp, Homo sapiens
aaaaagaaagaaagcaaaagaaagaaagagagagaaaaagaaaaaagaaagaaagagagaaagaaagaccatggtgtcacagtcttgatctttgggaaactgaccacccaagattccttaggtggtggtgacagaaagtagccagcagtcaacaccatggacccttcagcatggagggatttgatttgtgtcccagcgttctggctcatttcagcctctgcgaggccccacctcagtccagcagagcgtcccagtccgcagtgcggggaatcctggctgggcagtttgtcctctgcggcgtctttgccttgcactgctcagcttgcctccccactgtgtgctgctgcctgtgctctccagtgcggcgcattgctttccttcagattctggccccgaggccccacttccccaagtgtcaccctcctctatctcctttggcagcaggcgccccagggatgggttcactgatgatgacatcctgtttggcccagctttggcctccttttctcatatgtggtctgcgtggtcaggttgcagcaggtgtgggccccacttttcatgcaggcagaagcagcagcctggagtcccctgtctagtatcttagacagacaatgtctcattgacacagccccttctttctgcagccagccctttgtttcctgtcctgagtccttgttattttctctagccatttcttgcatgtgtgcagtaggtcagggcgtatgtcttggtactg

SEQ ID NO: 261371 - DNA, 880 bp, Homo sapiens
cgatcatatcagagtttctgaggatcagaaatccaggaggggcttaatagggtagttctggctcagggtctgtcatgaggtggccgccaagtgaaaccttccctggagctggaagagctgcttcagagaagactgccaccggatgcttggctggagttttcagtttttctccacatgggcctctcccagggctgctgagtgtccttgaactgtggcagtcagcttccccacagtgagtcgtgagagagggagacagccaaacagaagccctggagtctttcatgatctcatctcagacatgatgggccatctcctctgctgcactcgacagtcatacagaccaaccctgggaccacatgcaaggggaccacctgagggtgtgagtgctaggaggtgaggagccatcctggatgctggctacctcataggtgactggccaggcaaagtttattaactaaaagttctttgtgttgactcaggtgaactaacatttactgcttcagttgttcatttaatttaattttcttgagagatttaaagtaagtgctcaaagccaggcatggtggctcatgcctgtaatcccagcactttgggagcccaaggcgggcagatcacctgaggtcaggagtttgacaccagcccagccaacacgatgaaaccccatctctactaaaaatacagaaaattagccgggcgtggtgacgggtgcctgtagtgccagctacttgggaggctgaggcaggagaatcacttgaacctgggaggcagaggctgcagtgaaccaagatcgcaccactgcactccagcctgggctacagagtgagactctatctcaaaaaaattaattaattaaaaataaataaatgaataaagtgagtgc

SEQ ID NO: 261372 - DNA, 416 bp, Homo sapiens
ctctgctgaaagaagcatcatggaaacctggacacacatgagaaccggccttccacgcagggagaaagaagaggagcatgtgagtggtttgaagtaccctgccattccttacacatctgggcaaaactcatcataataaggaagaaatgaaaattgagacggaggctgaaggaggagccctgattctgttttcggctatccacaggatgggacattttatgaaaggattcaaaggaagctttcaagaaaagagttgcattcaagaggtattggggagctcaaacaattgtttcgaggattagagagctgcgcaagggagcctgggaagccatctcaatgtgaagatgatgaggatgaagacctttatgttgatccacttccacctaatgaacagtaaatacattttctctttctta

SEQ ID NO: 261373 - DNA, 819 bp, Homo sapiens
gagaactcaaagctggccatgtttcttctgcctgtgaccctttagaggcttcccaccaacctcaggatcaagaccaaatacttacactgctaagcatgcatggcatggcctccacatggctccagcctctttaggagccatgcgcctccatatctccacaggagctccctggcctcttccagcccctcccactgcaatgcttctcccatggggcctttgtatccctgttcccttcttccctgagctagcccttctcatcctttgatctcagcacccatgctgcttcctcagggaagtgaaacctccatgatggactctcatggtgccatttcattgttgcacttgtccctgtggcagctcaacaactgatggtctgagaatttgattaatgtttgtctctgcaactagactttacccctaaaagggcagggactgtggctgtttctgttaaccattgtaccccccaggcctgacacacagtaaacatcagaaaatagttgtggcatgttttcgagtgaatgaatggatgaatagcactctcctgtgtgcaggccgtgaggccatcccctagagtgtctcacaccagagttacaaactcgctggcataactggccatagttcaggagagatgagggcaggtcaaaggctggggccacgcactaagtgtgtccaaagggcaagaacgaatggaactggccgcagaccaacactgttgttctcactttcagtggggctgggctcacccccaggtgtcctttccctagctcactgtctttttcttttttgtgccttgagccattaaaccattattaggtctat

SEQ ID NO: 261374 - DNA, 457 bp, Homo sapiens
ctgtacatcctgcataggtacccctgaacttaaaagttggaaattttaaaaaaaaagaaaagcattttgtgtatttaaaagaacatcaaaagtgtgagatagaaagaaatctgtagttttgccaaagcataaatttgaatcttgaatttacaagctaaaatgggttctgagagcaagtgggtccactagtgaatgagccacgcccactgctgatcctcccaatctcatagggccatgagaaaggtccattccaagtctggaccagggaatgctcacactgtgattttttttaaggtgtcttctttagaaatggctccccaaagaaagtcaagtgctagtatcagagatggaagtgaagaagactaagaaagtaattctacctaacccggaaaatggaagtattgaccagattaaagagtggttaagtcatggccatgaatgaatttaccatatgaaa

SEQ ID NO: 261375 - DNA, 432 bp, Homo sapiens
tctacacagacacagtaacaatctgatctctcttgcttttctccacaccacaaaccccttagtattaagctccaagacatatttttgtcatatctttattgcttataattttctatctttagatattaagtatttgttgaaaatcccatgaaaagctttcagaaattggattgcatttcttgcttattatacatcccttgactattttgtaattgtgtgtatttgtggaggtcacatgtaaataaacttaaagtgactctactttgtgaaaatgtgaaacttcgtgtaggtactcagtaaatcagtaaattcttactaacgttagcccccagcctagctatggagggtgcatgctgagcccgaagcagagagctctgtaatctctgcattcatcaccaccatgaggaggcctcagaagcttctagcactgtt

SEQ ID NO: 261376 - DNA, 501 bp, Homo sapiens
tccagtgagggataaaacctttagcagagacttatcccacttgaggtaaggtcacttttcacactctgggcaccaatatccttcctgttccttgtaaggggagaagcaaagctaagaaatgcttgtaagggacatggaccccctaaaagactgtgatgtaatcataagagtatagaatacttcccctatgccaaccttctcaccacactaacagggctccaatgtaactgtggattacacctaaaagagccagaaaacacagactctctgtggaggagtatataaggatgcccaaagtcaagagtggagacaaaataaggatactagaggaatttgaagccaccgctacctacatctacagcaaacattatatatagcttgattctcagccagattaataataacaacaaaaaatgctcactaaaggcctgtttgcctcactgattactcttcaatatattatgtatgggttttaatggaaaattttaaggtatgaaaaaa

SEQ ID NO: 261377 - DNA, 415 bp, Homo sapiens
gcactgggggcattgctggggagcagcagtgtttgaggatgactggagctgtgcagagcatctcctgtgacctgaggatgtgccagtcatgtcctggtaccactcggggcaggccatctgcccctttcacttcatctcttccccctcacccacagcagcactggctccttggtgtgtgtatggccgaagagggcctggacacagggtaccctgggtgaaagatggggccgaggctccaaggctcctgctgtacttttcttctttttgagcaggagctggagggtgcctcaggaatacaggagggacatgggaggagggctgttgggctgagggctccctgtctggctgccatctcttcttcctgctaccctgttcacaaactgggggtgcttaactccctctgtgaatcaacatg

SEQ ID NO: 261378 - DNA, 434 bp, Homo sapiens
cagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaat

SEQ ID NO: 261379 - DNA, 541 bp, Homo sapiens
cttaccttttctctgtagctacctgtgtagcttcccttatttgtgcagctgcaagcatgtattaggcaagcacagagtgcagcttctcttgcctgagcaactacgggcatgttttaagcaagcctccaccccaccccatgcaagttctcatggagcccactgtgtacatgcccaaaaaggggaggaaactttttcctgggagtgcactgattacacagagaaccaaggcatttctatgttgggcctcactcccttatctgtgcctgtagcttgatttttccaagctgctctttatgtgcctgcagcttgattttttccagactgctgttttgtttgaaagaatttcaccgaggacctgccctaactgtctgcctgctttttttctttctccttcctcacttgggaggctgaggcaggaggaccacctgaacttggggaggttgaggctacagtgagctgtgattgcatcactgtactccagcctgggtgacagagtgagatcctgtctcaaaaaacaaacaaaaaaaccaaagaaacatgc

SEQ ID NO: 261380 - DNA, 433 bp, Homo sapiens
ccattctaattattgacttggaataaattcttcaatataaaaatatttggttaaattataggaagtttttaagaagttctttgttcattacttctaaattgttcccaagaaaatttatattcatttatagttcaacaaagggagtgtgaaacggccattcctctacccccaataatcattttcctttaattatacacttttaatcttaatatgcatggagtataaagaaaaatacagagtaatttatgactagtatattcaacatctctctctctcctaaataaataaaattaattccgagttctatgttaaaaatacttattatttttattttaaattaaatattatattctgtcttattctaaaagagatttaaaatttgttgataaaatatataataatcaacagatacatttaaagtattactaaaaaa

SEQ ID NO: 261381 - DNA, 478 bp, Homo sapiens
tccaggaggtagaggttgcagtgagctgacatcctgccactgcactccagtctgggtgacagagtgagaccctgtctcaaaaaaagccatcattgacttccactttcagctatttggacataactgttatggactagcttcctgctatgtattcaactgaatttatattgttataaacttttaatactatatgtgaagaggtattcactttaaggtagactgtgaaagttaaatacgaatagtataagggttaaagtaaccactaaattagtatgacaaagaggtataggtaatatgaccaaaaaagggagataaaatggactcataaaaaaataaatccaggctaggcacagtggcttatctctgtaatcccagcactttggaaggctgaggtcggcaagttcgcttgagcgcaggggtttgagaccagcctgggcaacatagggagatcctgtctcttaaaaaaatccaaaaggca

SEQ ID NO: 261382 - DNA, 297 bp, Homo sapiens
agggggtgccctgtctgcctgcagctgttattgaagatgtcccttttctcaccgtcaggttttactggaacagaagagaaagccagtgagatactaatcattagcaatgttaatattacctgatatttagttggctttatgcttttacaaaatgtacctccctttctgttgccaggaagattctagagcatgtagcaagaaaagcaagtaattgtctttctctgcagccctgtggaatcgtcgaaagagcacatactataccctaaaattaaacctagattgaagttctagctcctt

SEQ ID NO: 261383 - DNA, 229 bp, Homo sapiens
ttgttttgttttggatttccctaatgactaaacatgttcggccaggcacagtagtgcacccctataattgcagctattcaagagactggggcaggaggatttcttgaagccaagagtttgatgttacagcacatggtggtcacacctgtcagtagctactacattccagctgggacatcatagcaaaaccacaactctaaaaaagaacaaaacccaaagccaaccaaac

SEQ ID NO: 261384 - DNA, 502 bp, Homo sapiens
gcccccacctccctccttctatctcctgcccccctgtgcccttggagacacgctgggcagactccccatgtgatcaatctgacgtcttaagtttaaacgtcattacctcagtatatcagcagaaaaagttctatttcattgtgtcttgtggcaaacttcagttcggttaatggagggtttcgtatacttttaaaagtaagtcaggctgggtgcagtggctcacccctgtaatccccagcactttgggaggccaagatgggaggatcacttcaggtcaggagttcgaaaccagcctggccaacatggtgaaaccccgtctctactaaaagtacaaaaaattagccaagtgtggtggcgggcgcctggagtcccagctactcaggaggctgaggcagaagaattgcttgaacacaggaggcggaggttgcagtgagccaagattgcaccactgcactgtagtctgggcaacagagcgagactctgtcttaaaaaaaaaaaaaaa

SEQ ID NO: 261385 - DNA, 357 bp, Homo sapiens
cacaatctgcattgtatatctagtaagagaaatcttgttgagaattaaaatggttaaagataaaatagaaattattttttcaaataccgatgttttatttgcctctgtgttaatatttaaaaccaaaaacatttaatgaatatatcttcaaattcttcaagctgaaattcttaaatccataattaattcaaaaggaattagaagagcagttcaaatcttagttggtagtgctagggatgcattactgtcctttgtcaaaagttactgcttagtattctaactatggtgatttcttgctttatttttagattttaaagggaaaaaaattaaaataaaaaaactttttgggaaaaaaat

SEQ ID NO: 261386 - DNA, 465 bp, Homo sapiens
attttactttctgtagaaagggtgctgcccatcagcaatcctgccaggagagcacaatgaacaaagaaaggcaggaatatttatcccttatgcattgggtccttactgctgtgtcctgtctccattggttggagctggacctcacagtctaagctaaacccaattggctaacaacttaaaaaactttcttaaataggtaaaggcaatggagaacaaaggaaaagaggaagttgcttgccaaaagacttggagaagtaataacatttccaaataaggaaagggcataagctgtgagctgggacatgcttgagcacgtcgagaccaaatatcttggttaacgtacaaggacacagaaggtacttatttccttatatctaacaactacataagatatggtttaaaaaagagttactaacacaaagcaaagaggcttaaaaaaagttaattaaaaatattatttctaac

SEQ ID NO: 261387 - DNA, 1955 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctc

SEQ ID NO: 261388 - DNA, 2367 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261389 - DNA, 2345 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261390 - DNA, 2731 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcaggtgggcggcggggcgagcggagaggcccgcggggctcgcgggagtccaggggcagacgggacgggtctccgtgctgaagcccctggcgctcccgccacgtgagttcctgggctcccgccggtcagggccgcgcgacccggtccccgtccctggggcctggccagagtcgctcgcacccctcctgccccgcgagctggcgggggaagctgggggcgtctccacagccttggggggcagacgcgcgctcggtgtggggtacagttcacgatcattttcacgactttttaaaggcagtaatcgttctggtcactgggacacagctgccctcgcccattctaaaaagtcagcgccgtcaggaccgcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261391 - DNA, 1374 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagactgacaaaacacaaaaaaacccggggctttcttcggggggggaaggttaagggcctggattgtctcgcccctttttgcaggggaaatcggggccccaggggga

SEQ ID NO: 261392 - DNA, 2167 bp, Homo sapiens
cggctgtcggtcgccgtttggattcgtcacccaggcgtcgcgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261393 - DNA, 2409 bp, Homo sapiens
ccttctgatcgctggactgactctctcgccttctcttggtgcagccctcgggaggctcggtcacactctccgagagcacggccatcatctcctacggtaccacaggcctggtcacatgggacgccgccctctaccttgcagaatgggccatcgagaacccggcagtcttcactaacaggtgacctcggggcgcagggcagggcaccgaggcaggcttacctcccgttccagtcgttaccacatggctctgtcccagagccatgccctgtgtccttcagagaccacaggaggaaaacaaccacttctgggacgaagacagggcccttgagagaaggtggtgtttggctgggccaccgaaaacccctcacccctgccagcacactcagtcccctctctggtggaacagagctctgcctgtggtcctaggtcccagccctgaaacccacaggtccagcggtggccagggacacaagcccacccctgcaagccagcagacaaatcagcagatgcctgaaacatgaagttcatggcagggtcaggctttgtgtcattcaaagccctctagataggccaagaaccagagctggttttttaaggaacaccagtgagtctggagatttttttcttttgcttcggtcttttgcagctttctctactaagggttctcctttttcacccaagtaattgcctttccatctaatggcccaaatggtcaaatggcatctactagtctcatatgaccgctgcctctctggcctcgccctgctgctgacgtcagcatgacctggacctgtccactggtccctttcagtaacctgaagctttcaccatagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261394 - DNA, 742 bp, Homo sapiens
cttctcaatggcctctcattagaggcagacatcactgccaagttagacagccccagggtgacagtggcccagctggactgggacgtcgcgacggtccatcagctctctgccttccagccagatgttgtcattgcagcaggtaatgcccagccccgggcaccctgtgcaggtggtgtccttgcagctctacccagctcttggctctgggaaaagggaacaatggacgctgtcgggcatggacatgatggggcttccagaagagttactctgggcctccagggtgacatcacaggacaggggtgcctcttaaggtgaccttcaacccacagccctctttttggagacaggcatactcccgttccagtcgttaccacatggctctgtcccagagccatgccctgtgtccttcagagaccacaggaggaaaacaaccacttctgggacgaagacagggcccttgagagaaggtggtgtttggctgggccaccgaaaacccctcacccctgccagcacactcagtcccctctctggtggaacagagctctgcctgtggtcctaggtcccagccctgaaacccacaggtccagcggtggccagggacacaagcccacccctgcaagccagcagacaaatcagcagatgcctgaaacatgaagttcatggcagggtcaggctttgtgtcattcaaagccctctagataggccaagaaccagagctggttttttaaggaacaccagtgag

SEQ ID NO: 261395 - DNA, 998 bp, Homo sapiens
  misc_feature (882)..(883): n is a, c, g, or t
  misc_feature (888)..(888): n is a, c, g, or t
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggtgacctcggggcgcagggcagggcaccgaggcaggcttaccctggtgcagtcgcagacacggtcccctttcctcccgccaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgnnattgncccaaaagcatcatgtcgcggacagggaaccggggagaggggagagcctggcgggaggcaccaaggggacactgaaggataacgcgggcatatacggacggaaccccaaa

SEQ ID NO: 261396 - DNA, 2424 bp, Homo sapiens
cggctgtcggtcgccgtttggattcgtcacccaggcgtcgcgaggagaacgcggggaccgaactcttgctgcagagtttcgagcgccgcttcctggcggcacgcacactgcgctccttcccctggcaggcagtaatcgttctggtcactgggacacagctgccctcgcccattctaaaaagtcagcgccgtcaggaccgcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagcacgaggctgtccacacagagcctttggacgagctgtatgaagcgctggcggagaccctgatggccaaggagtccacccagggccaccggagctatttgctgccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261397 - DNA, 2265 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggcacgcacactgcgctccttcccctggcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261398 - DNA, 2322 bp, Homo sapiens
cggctgtcggtcgccgtttggattcgtcacccaggcgtcgcgaggagaacgcggggaccgaactcttgctgcagagtttcgagcgccgcttcctggcggcacgcacactgcgctccttcccctggcaggcagtaatcgttctggtcactgggacacagctgccctcgcccattctaaaaagtcagcgccgtcaggaccgcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagccctcgggaggctcggtcacactctccgagagcacggccatcatctcctacggtaccacaggcctggtcacatgggacgccgccctctaccttgcagaatgggccatcgagaacccggcagtcttcactaacaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261399 - DNA, 2346 bp, Homo sapiens
cggctgtcggtcgccgtttggattcgtcacccaggcgtcgcgaggagaacgcggggaccgaactcttgctgcagagtttcgagcgccgcttcctggcggcacgcacactgcgctccttcccctggcaggtgggcggcggggcgagcggagaggcccgcggggctcgcgggagtccaggggcagacgggacgggtctccgtgctgaagcccctggcgctcccgccacgtgagttcctgggctcccgccggtcagggccgcgcgacccggtccccgtccctggggcctggccagagtcgctcgcacccctcctgccccgcgagctggcgggggaagctgggggcgtctccacagccttggggggcagacgcgcgctcggtgtggggtacagttcacgatcattttcacgactttttaaaggcagtaatcgttctggtcactgggacacagctgccctcgcccattctaaaaagtcagcgccgtcaggaccgcagagcttagaagcaaagttaagagactcatcagattctgagctgctgcgggatattttgcacaagactgtgaagcatcctgtgtgtgtgaagcacccgccgtccgtcaaatatgcccggtgctttctctcagaactcatcaaaaagccctcgggaggctcggtcacactctccgagagcacggccatcatctcctacggtaccacaggcctggtcacatgggacgccgccctctaccttgcagaatgggccatcgagaacccggcagtcttcactaacagatgtgctgtattgcccagaagccatcatgtcgctggtcggcgtcctgcggaggctggctgcctgccgggagcaccagcgggctcctgaggtctacgtggcctttaccgtccgcaacccagagacgtgccagctgttcaccaccgagctaggccgggccgggatcagatgggaagtggaacctcgtcatgagcagaaactgtttccctacgaagagcacttggagatggcaatgctgaatctcaccctgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcagttcctcacaaagccaagcccactgcagctgccacatccctgggcttacggtgcagcaggtgcttttttcaagacaggaatcaaaatgttaggaacacggcagaaaggggacacctggagaccaaacgcaggatgaggagttctgcagaggtcacagggaagtcacagaacagtaatacgctagcaggggcatggggcgtgaagaacagaagaagagaggaagcgtttccaagcctccagagaagaaatcaaggccaaccaaagcttcccgggtcacagaaccaattcttttaccaggcagtaccactgctgtcatttcagcttctggccactgggaggtgctgctcgaaagggtttgccctgagactccaagaagaagctgcgggaaggacagcaggggtcctggggttttagcctctggcccaggagttatgtgtccataaccaaagggagcacagtctgcacccagctctcatcccatcggagctgctgcgactcccgcaggttcttccggaactggtttagcttgcccgcaggatcaggaaagtttgagaaaagcatctgcaaaaaaataaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcgcctctggccaacgcagtcccacccatctgtgggtaacaagggggtgtcggtgttctttgcagccttgctaaactgtctgaatcaaggatcacaaactacagctgcaggccaaatccagcccacagcctgtgtttgtaaataaagttttattggaacaa

SEQ ID NO: 261400 - DNA, 515 bp, Homo sapiens
tccacattggcagtttccaccaactggagatggaaaatagatttaaaaaaaaaagaaatggttgcatctctactgagaatgttcgtatttttttcttgtcattattccccaaacaataaagtataacaactattaacatagcatttacattgtctaggtattaaaagtagcttagagatgacttaaggtatacagcagagtgtatataggttatatttaaatactgagtgccagtttatatcagggacttgaacatccatggattttggtattttgtaggggagtgttctagaaccagtaccccacagataccaagggatgacagtactagtgaaaacaaacaacatcaaattttttgaatctaagatactattgattgggagataagtcagtatcttaatttattatattttatattttacatatttaaaagtatattttcatatattttctgctactgccagaaaagaatatgccatttcacttggagaaaatggtgttaaatacaaaatcaa

SEQ ID NO: 261401 - DNA, 232 bp, Homo sapiens
tgttggtattttttcaatttgaggaaatgataaaatcaccatgctattgtttcattttctttgttctaaaactttcagaatgtattaagtgcttgttgatcatatttttatttattcttcaacctggattatattttttgcctaattttaatcttccattttacagatttcaattgagcttattttttaaaacaggttgattaaagtataattaactttcagtaagctgcac

SEQ ID NO: 261402 - DNA, 262 bp, Homo sapiens
accagtttatgaccccattttactaacaagcaaactgaggctcatagaggacaatgatttaacgagggtcatacagctgttaatgggtagagaattaaaacccaagtttttctgcttctgggtcaatgttctcttcaatataccactctgccttcttaatttctagattaagaataagggctgctcaaaagtttgaggctgcagtgacctatgatcgtgccactgcacttcagcctggagagcagagcaagaccctgtcttt

SEQ ID NO: 261403 - DNA, 567 bp, Homo sapiens
acgctggtaaggtgaatgatgagaactattatcttgctaagtcaaacaagaagacttccctcatcagaacttttaagacaaaattattttacacaaaaatcacctgaacaatcacctaaatttccaattttcataaggcagtgccacctcttaggttagtatgatacagaagtcagcaactgcccattgttcctgagacaagtcaaggagcaatacacaattaaatttcaatgtatattactccaccttataccttaaccgttccaggaatgaatgataagactacaataagaatgctgtgtgggactgttatttgctttaaaaaaaatagcagaggaggggaatcataacaatcatgattcactcagacttaaatgaagaatatggtaccaaaattatacagaacagagaagatacgaaacactcattttaacatcaatatattgggctaagggttcagaaaaatgaagcagtgtatatgtactaacatgtttaaaacacacacatacatttcttgagttaaagaaaattcaaaaatttactgagagccaagtagaacatgaatgt

SEQ ID NO: 261404 - DNA, 564 bp, Homo sapiens
ggacccatttattgatatgaggtggagatctatctgggcccctcagccagcttgggactaggtatcttcatctgcaagtcactcaagagtcatccccctccttaccaggctgcttccaatcacagctgcctgcgccccacctccagagactgattcaatggatctgaggtgctctctgggaatgtgtttgtttgtttgtttatttatttatttttgagacagagtctcactctgtcacccaggctggagtgcaggtgtgagccaccatgcccagccgtgttagtataattttcatggcactttatttccttattctcaccccattccatacaatgattcaactgattgaacctctgcagagacaactgtgggttctgcttctccttttccagtcaggcagtgctgctggcattgcccagtagctgctatcctcttcccacaccaccactgcccccaccagccagtgatctccctaaaactcagagctaatctcatcttccacttgcgggtctttcccagctctcctccttagatgacattgagaattctcacctttcacttggc

SEQ ID NO: 261405 - DNA, 409 bp, Homo sapiens
ttagtttgtgttgtgtcacctgtgagcctccttgtctggcctttgtctttattaaaatgcttggatataatacaagttttgaaaaagacttgtttttagtaagtagcatgtctttaagaagtcaccccccttctcatcccagtgcttagtctgtactatcaaaacaagatgagagaatctgccgggcacagtggctcactcctgtaatcccagcactttgggaggccaaggcaggaggatcacctgaggtcaggagttcaagaccagcctggccaacttggtaaaacgttgtctctactaaaaatacaaaaattagctaggtatggtggcacacgcctataatcccagctactcaggaggctgaggcaggagaattgcttgaacctgggaggtggaggttgcagtgagc

SEQ ID NO: 261406 - DNA, 391 bp, Homo sapiens
caaccgcagggaactgatccaaccagcaggtggcagaatcaggattcaaacctaggcacgtctgttccaaagcctgggctctgaaccacagccactccaggccccctcccagcccagcaggcttgggctcgtttctttgctgagtctctgttacctcctctttattttaattttaatttttttattttaattttttgaggcaggctcttgctcttggggttctggaggcgggaattctgaaatcaaggtgtcataggctgtgttccacctgaaagctcagaggggcctcctcgcctctccaagcttctgggtggttcaaggtgtcccttggctttggagcaacttggatggaggccggggtcattattctaagtgaagcaactcaggagtg

SEQ ID NO: 261407 - DNA, 234 bp, Homo sapiens
gttattacaacattcttgaaattacaccaaataactcctcctctaaacagagaaatacccatgttgggtggcacatttggatggctgggggtaggagcgtggtactgtctgatatactctcagccagtcagattgggtaacatgtggatggagaagacagcatggccagtccagggctagacactggggtagagaacgaaggagacagggagcagaggacatctagcccctcag

SEQ ID NO: 261408 - DNA, 124 bp, Homo sapiens
tccctttgggaagaccaggtggtggactgggaagagggagacggtccttcctagagacgcagagtgacaggagccgagccaggtgcagaagacagggaggtggattcacaggcaatgacagatc

SEQ ID NO: 261409 - DNA, 425 bp, Homo sapiens
ctgaatgaactacaagatctcttctgtatccattacattaaaagcactgtgctagagccactatgtggagaaattaaagtatgagtactatgctttaaaaaattacaatctaataggacatgtccacgaaaaggtaaataataggtcgggcaccgtgcctcacgcctgtaatcccagcactttgggaggctgaggaggatggatcacgaaagtcagcaattcaagaccagcctgttcaagatggtgaaaccttgtctctactgaaaatacaaaaattagcggtcgtggtggcgggagcccgtaatccagcttcttggaaggctgagacagagaattgcttgaaccgaagaggcggaggttgcggtgagccgagatcgcgccgctgcctccagcctgggcgacagagtgagattctctcaggaaaa

SEQ ID NO: 261410 - DNA, 400 bp, Homo sapiens
ttgactggagagagcattttggggtttttgttggttgaaagaggaggacaaaataggagccaggctagggctgccaaggagtagctgaatgtagaactaactggaggagtgaagagaggcaggagaaagagaaagtcttttttagatgttaaaaactctggtggacaaacctattttttctgaggcaggaatattgtttgattccaggagttcaagaccagcgtgggcaacatatcaagaccacccatctctactaaaaaaaaaaaaaaaaaaaaaaatagccaggcgtgcctgggcatgactgtagactcagctgtaagggaggctgaaatgggaggattgcttgatcccaggagttcaaggccagactgggcaacatagtaagaacctgcctctatta

SEQ ID NO: 261411 - DNA, 1037 bp, Homo sapiens
gtaacaggcaattaggattcataagcatcgcatggctgagacatgatttaaggtcttagatggaaagagttctgttattaagataacagaatttaaatgctgtatctgtctaggtcttatgcatgtcagaagtgagaaaactactccttcattttccatttttatgagctctgatgtaacacagtttttttttttttctgtgttgaaaatgatgaatatagttcttggcacatttgttccatagtaaagaagaatttaacttgcaagtgaaaaacctctgcctttggccatggattaaaaagatgttatatgatgaagtttacttcctaaggaaaggttagttttgtgtggcactttctgaaaatttgtttgggacatatacaattcttttgtataaattctggaggtctgaggaaaattacttaatcacattagatgagaacatttctttttgtgtgaattgagttcttatcaaggttctgatgttttttctcatgtatttgcccttgggttcatctcaatacaatgcatttgtgtactattgaataaaaagcaggctgcaacagtatttatgacatatgatcctatatacacgtaaaatcttgtgtgtgtgtttgtgtgtgcacatgcatataaaaaaaactacattgttaaagttgttaatagttaactcccggtggtgggttttaagtgattattattttctttgtataagaaaaatagtgcacagttttcttttgttgttacgaaaggtgtcatacatttgaaagaggacatatgcacagtttaaataataataacatagtgaatacccactgcttggctgaaaaaaataatttattactctgttgcagaaggcaagccttccttctgcccctgcctctgtcatggaggtagctacttgcttgaattttgtgctaatcatgtctttgctttcttatatagtttagccagctgtgaatgtctccataaaacatacacagttttattttgattgtttttgaactttaaataaatgaaatcatactggataaaaa

SEQ ID NO: 261412 - DNA, 911 bp, Homo sapiens
tgagaagagaattcaatatcaggggcctgtttctagacagcactcttccagctcacacgccctccccttctcattgagaccatggcggggtgggggcatgaaggactggcaggggtgaggagaacacaggttggccaggtgcccttcacaccaaccccaagtgccccaggggtcatgcagacctgtccagcttgtgctgctgaccagcagagctggccgctcgtggagacgtgtcaccagcctactcccagcatcccgctctgtgaaggccaaccgctctgtggctgggtcctcaggttctgagatgaaggagcagaaaaaaaccctgtgagaggccacagagcaggcccaggacccagaacgggcatctcttgccatggcgaggcctgcagactcccaacggttggggtggccagccacatcagcagcaccaggccatccctgccatccggggcctgggcttgctttctctaatattgttgctgggtgctaaggttacaacagcaaacaagactgactcattccttttctccatgggacttactgtcttatcatcccctggactcaagatgagcatgctaggacgccctcccacaccaccccagcttacccaggtgcccacctcagggtgtgtggacctgcagaaaggtcccctccttagccccgtgagacaccccaggggacacacaggtccacagatcctgccgcaggcctgggaacccactggcaggagagtaagacagtgcaggggtccacaaacatttcctaaaaggccagagagtaaatacttcaggctttgcgggccacaggttctctgttgcaaaacgcaattctgctattgtagctcaaaggcggctgtagacaactcagaaggcaatgagtgtgttgtgtcccaataaaacttgatttac

SEQ ID NO: 261413 - DNA, 435 bp, Homo sapiens
tgggaggtaaggcagagctactggggagcctggaaggctgagatatgtctcccatacgcaagaccattccagaagccccttggagctctggctgctggccacaggggaaggtagaccttcccggaccctcaggggtctccccgccctaccccaccagcctgggttcggtacctcggggctcagatgtgcagtcagctgttaatgtggcaaaatttggggaagtcctctgcagccgcaaaatccagttcccaccaggcacagggacccacatcagccctctggccacagaaggcgctgatgatttgaggtggactcagccaccactccgagcctctgcctccctctaaaagtggggcatggcacattcctgtgtcaggcaaccaggcactgagcctggcccacctgcaggggtcggggggagcagcttgtccctgt

SEQ ID NO: 261414 - DNA, 369 bp, Homo sapiens
aaagcaaccgggagggtaagagaagggaaccccaggaacaccctttttcttaggggagcagaaacctacccctcccgattggaagtgccctatacaggtccttaggtgttgatatcacatgaagtcttgttgaaaacgaagatggaacaaaatgcagcttagtattttgaagaaaattggcttatgttttgcacttgcagttaaaaacaacaaccttaggcttgtgcttgcccctttcctccctcacctacctctcctaggttaaaacaaagctggaagcaaatcagttgtatataaaattatgaattgctatgggaactattgaaatgtagcccaatttaatagcatgtatcaagtttacttgtgtgg

SEQ ID NO: 261415 - DNA, 393 bp, Homo sapiens
tgactccagctgtccacctcgcacccagaagcaactccgaatttcctcacaggacttcaaagcctggcttgtatctaaacattcgttggccatgtaaatcagaggcacaaaaggagaatgctcctatttcatggtgctaggctagcttaagtctggctttgtgcagcacgtgccggtggggagtgccagcaacggaaggactctgttctgactcgtgtgacaaatgtagttaacaccggatccatattaatgttgtcaagttccctcgatgtatttaaacagattttaattattttcagcgtccacaggcctgaaatatatagcctaatagttcttcaaagaaagcttacttaatgtgtgaatgtaaaacctctcataaaaatgaaactttta

SEQ ID NO: 261416 - DNA, 738 bp, Homo sapiens
cttgctgctgcttttactagagatggctggaccagttgatgagaaacacccgaattttcacagaatgttaaatgtgccacataccaaagagtttctatttttttttaaatcattctgttatatccaccaagattcacctagattcgagattatttcatttgagaacgtgagattatagaagtaattgggcacatcgttactgttgggatggacggtggactttttggctcttagcaacactgaaagggaagacgtgcctagattggtttgggtaaccatattcagactggcacaggaaggcgagtcaagacaatagcactagaaggcttaggggaaagaaagccagcctcttcctcctcaggaactggtcaccaggtaagcctctttgcatcctcaactgagttctcatgttttaattgggttcgtgatatagaatctagaaaaattgtgtatgttctgagatcctgaggaagacaagaccaccacaaaattccacctcttaaacacacccttgcttaattcagtcctaaacaaattagctgtcactgacctcaagccagttaggcctctctctagttgggaaaactgctgtttgcaaaagcccagtaaaacacagttaatacatgaacaaatattaccaacacttgcaagccgattgcggtcatgagtgtcttaagagcgccatcgtgtacggtgggggtcagccaaggtgggaagaagggtatcattttgaagccc

SEQ ID NO: 261417 - DNA, 659 bp, Homo sapiens
caggctgattacttccttgtaaatacaccagaaggtgaaactagtttctgtgatcactatatcacaatagatttttatagagtactgtaaattaaaatccctaaggaatgtttatgagtggatacattccatatttcccccattttgtaaatatgtagttggtattttggattcattggtaggacctcatatctgcactaaatttaatttaaagaattcattccagcctttgagatacctatcatctcttggatcctgatttattatttcttctgttttttcccctaaaattctcatatgattttgatagaagtacattctgtatatatccatccaatatattaatttaaaaataatgtcaatggtacagggcagagatctgaaatgttttacgggaagacttatgcacccttctaggtaagagaccacacttaattattttattactctagcctcaagctcagtacttggctggccggagctgctcaagaaatatttgctgcattgaaagagctgttgaacatgcttaagctgtcttcatctaaccactctctagtaccaaacccatcagctgggctaccatccaatctgcattcctgcatgttaaagacaagatataatgagaaactttgccaaatgccttggtgaaatgtgtgtgt

SEQ ID NO: 261418 - DNA, 307 bp, Homo sapiens
tgtttgctgtgtggatcaaaaacccttaacctatggttgccagaccaggtaccttcttttctattctgcctgctccggatgcactttcaaccttagcaatcctcttttggtaaggcaaaatgctgcacttgatgaaaatgtttagaccgataaactttatgctttataatttagggcttgtgtaaatgcttggggcttttgagttgtattttatttaaagattttcatatttctgctcaactgttaaattgtgacaattttttctgaactgatttgatctataataaagcttcaatttgtattctaa

SEQ ID NO: 261419 - DNA, 338 bp, Homo sapiens
ggagagaagctaacggtgctcatcgtgtggcacgcaggtgcgttgttttctctccactaaggctgctgggtggggccaaaatagtccaggcagccaagtgcagaggcgttgggggcggcaaagatgcaaaggatccccactgtggctgcaccccgaggaggagtccgtggcaggaggcccacacccaggacccggcgccaacagtgaggagacgaacctggaagacatcccgctgtccagacaccgcgagggaggcgagtggtgctcgcagcctgggacttaggaacacagggaaacagcttccacatgtccatttgctgaataaatatttcttgcag

SEQ ID NO: 261420 - DNA, 249 bp, Homo sapiens
gagagatagagagagagagagagagagagagatagagagagagagagagagagagagagagagagagagagagagagagagagagagagagcttagtctttcaattacaataagctattggaataaccataaatgtaatatatatatgaaagtcgtgactgcatactataagatagcaacacatgtgctttgtactaagcactttcatatatctcacttcatcctcaactctgattgaaacttatccaa

SEQ ID NO: 261421 - DNA, 530 bp, Homo sapiens
gcccagagccagcacaaccagagcctcgagtgccacgccttcctctgcaccaagcggaagatgagatcctgactaatacgccaaggcccagggctgcatgcccaggactcaggaagagtctcgaagaatcctctgcacacaagaacactgctatccgccgaagctgatgtcagctattccctgcagactggcctggtccagcagagccagctctgctaaactaccacaggcaggaagaaaatgagccaccaggggcctccacacttgtctctcataaaagatatatgctccacaaggacaggggttgagtctgtcttgttccctgctcaataattgtgtgctatggataagtaaatgaatggatcaagagataaggatggaagagcaatttacaaacccaaagcattgtgcaaggcagggcataattgggtaggaatgcttcttctagaagttattccttaggaaaggccaaacaaaaagtctattaatagacccgattaataaacatcagccaaggtaaatgttaacag

SEQ ID NO: 261422 - DNA, 707 bp, Homo sapiens
ttacagtagctgaatataactggccagtgcagaagagcctatgaaggtggaaaatggaggaaggaggaccccatgctggagaagtgatggagatttgaagccttggaagatggcggcaagggagatgccagagatgagacaatgttaaacatctgtaatctaacagtcttctatgggagtttattacatttccatatcctatgttcacttctagtgaaaaataaaaataaaatcttaagccccccacagctgactaaatggatcccattgtgaaaggaaaatatcttgagcctccaaaatcactaaggaaaattcaagctggaaacttcttaggacaaacctgcctcccattctcttcaaagttattcctctgctcgaggagctagatgcatatctgattgccgcctttggaaaggctaaccagaaactcaaaagaatgatacagtttgttatcacctacctgtgacctggaagctccctccctccccacttgagtcttcctgcttttgtttcaagctgtcctgcctttccagaccaaaccaatgtacttcttacgtatattgattgatgtctcactcatgtctccctaaatcgtataaaaccaagctgtgccccaactaccctgggcatgtgtcatcaggatttcatgaagctgtgtcacgggcgcattccccaaccttgaaaaaataaactttctaaattaactg

SEQ ID NO: 261423 - DNA, 200 bp, Homo sapiens
tggaggggaaggaattgagtacttttcatagaattttttcaagaaaaaccaattccatcaaattggctttagcaaattcacaagatgctaaccctcacgctctcagatctgagaatgccattattcgagttgctttccatgagatcttcctcttgcagaattctcacttccttcctaaaatgtccctctttccaaaaact

SEQ ID NO: 261424 - DNA, 545 bp, Homo sapiens
tcaccgtgttagccaggacggtcttgatctcctgacctcgtgatccgcccgccttggcctcccaaggtgctgggatcacaggcgtgagccaccacgcccagccaaaaagttgttttaaaattttttcgagagataggatctcgcttagttgcccaggctggtcttgaactcctgggctcaagcaatcttcccactttggacccccacagtgctgggattacaggggtaagccaccacacccaacctcaatcttcttgtgatctgttatgttgacaaccaagacagctacttagtggttggttgatgggtggacagtgtatacagcatggacacactggacagaggcatgactcaatgttccagtattttcagatttcaggtgactgctgtaacttgaagcaagaaaagtgaaactacagaaaagggaggaccactggacggctgctttcattctacgcccactttttagagtgcattcctacaataagcaccctaataatgtaaaccaggggccaagggatgcaccttccactctacttccttcc

SEQ ID NO: 261425 - DNA, 1613 bp, Homo sapiens
cggcgccggaagcacgggtccgggccctcccgcggggcgggtactcgtctcccggccgagcgacttcagctcggggacctgccccatggccgctccccagcaggacagggtaaccgccgaggtggggggcttcttgtccgtcccagcccccccaactcaggccctctcgctgcccctggcgaccaccgcgtgcgcccttccccagggcgggcgcagtcctggacgcctccgccgagcgtgactgcgtgcattttctctcctttcccttcccaacctgcggagagaagacagccccagagccgctgtctccatcctctgctgatgcctgctgtctttatgttggcctcgtcgtccgcactgcagtgtggcaggggcgtccctcgtttcccgcggactgaggtgggcgccgggcattcagtaaacgaagaaaccaaagcggagaaggttgggaatcaaacgtctgtcatacctgccaccagcagacaagcggctttgggtacctcctggacccaaagacgaactcagcccctccaggagcgcagtcattggcaccctcgtgggaacaatgccagtgggatgggtggccaccggatgtttccggggcccctcagaggcccagcagcgcaggtcttggagaatgaatgtgggtcactgggccgcgctgcagagggccggtcctgagtcgcttcctggaggagaggcccatggccagcacttggcttcgcctggaggaagaagcacgtgctaaaccacgagcgttcagggtttgtctgtttgataaaagatgctggctttgacacaccaactgacaaagtctttcataggttggagctgctaggttgtgcccctgcccctcctgaaaattagccacacgaaaggaagggtctggaaggtggcagggaagccagcagagaccagggaagtggcagcagcatggggcaggggcacacaggaaggagatggagcttgcgggagcccccactgccactccgacagggagccctgccccgtgccctgctgatgttgacactgaccccggctctattatttcagtttttccttgtaatttctgaaaatctagcaacaagttgagcaatgaaaaaaagtaaaaaagttaaaattgtgttagaaattatgactgtaaagaaattttgaaactaatgaagaaaaaattgccaaaattgccaaagcttttaggactcttaaaaatatagtaacattgagtattatgaactaaagactcatactattatatcagtgtctggtagtgaatttggatggaggactgtctagtaacttcttaacaaaacattgattagaagtctttcttggcggggcgccgtggctcacgcctgtaatcccagcactttgggaggcgaggcaggtagatcatgaggtcaggagatcgagaccgtcctggctaacatggtgaaaccccgtctctactaaaaaaatacaaaaaaactaggcaggtgtggtggtgggcccctggagtcccagctactcgggaggctgaggcaggagaatggcgtgaacccgggaggcggagcttgcagtgagccaagatcgcgccactgtactccagcctgggcaacagagcgaggctccgtctc

SEQ ID NO: 261426 - DNA, 1120 bp, Homo sapiens
cggcgccggaagcacgggtccgggccctcccgcggggcgggtactcgtctcccggccgagcgacttcagctcggggacctgccccatggccgctccccagcaggacagggtaaccgccgaggtggggggcttcttgtccgtcccagcccccccaactcaggccctctcgctgcccctggcgaccaccgcgtgcgcccttccccagggcgggcgcagtcctggacgcctccgccgagcgtgactgcgtgcattttctctcctttcccttcccaacctgcggagagaagacagccccagagccgctgtctccatcctctgctgatgcctgctgtctttatgttggcctcgtcgtccgcactgcagtgtggcaggggcgtccctcgtttcccgcggactgaggtgggcgccgggcattcagtaaacgaagaaaccaaagcggagaaggttgggaatcaaacgtctgtcatacctgccaccagcagacaagcggctttgggtacctcctggacccaaagacgaactcagcccctccaggagcgcagtcattggcaccctcgtgggaacaatgccagtgggatgggtggccaccggatgtttccggggcccctcagaggcccagcagcgcaggtcttggagaatgaatgtgggtcactgggccgcgctgcagagggccggtcctgagtcgcttcctggaggagaggcccatggccagcacttggcttcgcctggaggaagaagcacgtgctaaaccacgagcgttcagggtttgtctgtttgataaaagatgctggctttgacacaccaactgacaaagtctttcataggttggagggcacacaggaaggagatggagcttgcgggagcccccactgccactccgacagggagccctgccccgtgccctgctgatgttgacactgaccccggctctattatttcagtttttccttgtaatttctgaaaatctagcaacaagttgagcaatgaaaaaaagtaaaaaagttaaaattgtgttagaaattatgactgtaaagaaattttgaaactaatgaagaaaaaattgccaaaattgccaaagcttttaggactcttaaaaatatagtaacattgagtattatga

SEQ ID NO: 261427 - DNA, 1232 bp, Homo sapiens
cggcgccggaagcacgggtccgggccctcccgcggggcgggtactcgtctcccggccgagcgacttcagctcggggacctgccccatggccgctccccagcaggacagggtaaccgccgaggtggggggcttcttgtccgtcccagcccccccaactcaggccctctcgctgcccctggcgaccaccgcgtgcgcccttccccagggcgggcgcagtcctggacgcctccgccgagcgtgactgcgtgcattttctctcctttcccttcccaacctgcggagagaagacagccccagagccgctgtctccatcctctgctgatgcctgctgtctttatgttggcctcgtcgtccgcactgcagtgtggcaggggcgtccctcgtttcccgcggactgaggtgggcgccgggcattcagtaaacgaagaaaccaaagcggagaaggttgggaatcaaacgtctgtcatacctgccaccagcagacaagcggctttgggtacctcctggacccaaagacgaactcagcccctccaggagcgcagtcattggcaccctcgtgggaacaatgccagtgggatgggtggccaccggatgtttccggggcccctcagaggcccagcagcgcaggtcttggagaatgaatgtgggtcactgggccgcgctgcagagggccggtcctgagtcgcttcctggaggagaggcccatggccagcacttggcttcgcctggaggaagaagcacgtgctaaaccacgagcgttcagggtttgtctgtttgataaaagatgctggctttgacacaccaactgacaaagtctttcataggttggagctgctaggttgtgcccctgcccctcctgaaaattagccacacgaaaggaagggtctggaaggtggcagggaagccagcagagaccagggaagtggcagcagcatggggcaggggcacacaggaaggagatggagcttgcgggagcccccactgccactccgacagggagccctgccccgtgccctgctgatgttgacactgaccccggctctattatttcagtttttccttgtaatttctgaaaatctagcaacaagttgagcaatgaaaaaaagtaaaaaagttaaaattgtgttagaaattatgactgtaaagaaattttgaaactaatgaagaaaaaattgccaaaattgccaaagcttttaggactcttaaaaatatagtaacattgagtattatga

SEQ ID NO: 261428 - DNA, 222 bp, Homo sapiens
attctttagaagttgaattaataaacggctattgtattaaattttattttaattacaatggttttccttcctttccttttttacctgagtagaatctcttgttattttctggacagaaaaacagatctgcatgtggtggtaattttactccttccatttgaatatatgtatctctgttatgtgcttgtttatctaatattaaataaaattattcactttcta

SEQ ID NO: 261429 - DNA, 823 bp, Homo sapiens
ctggccctgccaccgagtctgccttcgccacagagaccagtggtcatgcagttgttcccagggaccatttgcataatgttcatgtatttatttgggggttggccagacgtcctccatctctaccagtagctatggaaatcgctccagttaaggaaaatgtcatctgtttgaaacagcaggacaccagctacaggcggatgactccagatgcccctagcagatgttgcatgcttcaagcgtgggcaggctgctgggtggaacaccttcaaagaaagatggaagcgcgggttcctgttctggactcttaactgacagtggttctttaagtaggctaagaaatcagaacaagcaaaataaagggtaaaaggccaaagaaatgtaattctgttggaatgtttttatccaactgttagagaaaataaattgtgggtgttgcctttcactgagaagcacatattgttttctgactgattttttaagtgtcttcaaacaaataaacacatctatttgctttcctccaaacaccattagggtaagaaatgctgatacataaaggaacaagagagcagcgggtcacactttattggttgtatagtaccaaagccaaagctaatttaaaagtccttaaaattttacatacacacacacacacacacacacccctatgccccacacaattcatgtgtctatgaagaattttccaaacacgtggagaccataaccccatttcccttgccttaatagtgaggagacttatgtattccactaaaccaatatttttattacttttttgtcctgtgtcctaatttttattatctttaaa

SEQ ID NO: 261430 - DNA, 505 bp, Homo sapiens
agagtcccctactcccaattccaaggatgtccacctctgccttggcccaaagttctcacctctaccaggctctcccgcacctgtggtctgagacatcagctggtgggtttggctttgagaataaacctgggtcacttggcgggcttttttctgtctgcttgccaggaagcctgctgaattcctctccacctctgcccttgtccacagagaggggcggcccatgcagttcacagctaaacttagcctggcaacgctggagtcacggggcaacaggggctgagggaagatggaagcttctgggtggcccggacagagggctgcaggtggctggctgggaccagtggtttattcagacctttactgtgaggctggccggaagccaagaccctgggagaaatccaaggcttccttccttcactggggtccctcactcctgggtcccccagagcctgcagcactccccaccatagcttaatccaataaacaccacaaagcattgcctaac

SEQ ID NO: 261431 - DNA, 490 bp, Homo sapiens
cagttatcctgaaaatgggaggggaggagggaaatgaaccagggaccgcatcagcaccagaactgaaggagtggaaaataattagaagggaaataagacacagagaaaccaggatgggcaaagagaaatgtgtgattggggaaaaacaatatccttacctcatccttttcgtttcttcctactcacagaatgttaaatgcactcctaaatgaaaatagtgtggatgtgtgagtggctgtcactcagacagaggagggaaaaaacccaacttatttcatcttcatcatcttattttgtcagaccaagcagaatcctcctcaaactatccagagtaactttggttaaaatatgggtgtgtggccaaaagctttggatagatttattttgtacgaattttaaaaaacaaaatgttagcatctttgcttatggtagttttgaaagaaaaatatacatatttcctaagctgatattaaaagtggcatttatgtaa

SEQ ID NO: 261432 - DNA, 335 bp, Homo sapiens
taatgcgtgataaatacatgttcactattgtaattattctgaaatgcccatttatatttcccacactggcccgtgcaaactattttgagatagggcgaaatcaacgcatcatcacactgaaacccccggtcacaatcagatgcagtttcctataatatgactttaaattgtcaaaggatgccataaaaaacacaaagagttggtttccaccacatgaattcagggagcttctcatattctatgcccagataaataatgactgtgtctggaaacaggcaaagaaagacaaaagggagataaactcctagacctctctttccaggctcaaagcaaaa

SEQ ID NO: 261433 - DNA, 318 bp, Homo sapiens
ccatctcctgaatggttttcatcttcccatactgaaacacagtagccattaaatcatcttttggcttccctgggccacattggaagaagagttgccttgggccaaacataagttacagtaacactaacgatagctgatgagcttaaaaaaaaaaccacacaaaaaactcaacgttttaataaagtttatgaatttgtgttgagcctcattcagagctgtcctgggccacaggttggaccagcttgcattaaacactaactcctgctcccgcccaggagttcgagaccagcctcagtaacatagtgagaccccatctcc

SEQ ID NO: 261434 - DNA, 524 bp, Homo sapiens
aggaggatccttagccttctgtgctggcctgtttgtaagggaacctttctgcatctgtggcctgcttgggagcaccctcgattgcagctgttggagagccaacggtaataagaactgaacattcgtttgcactttagagatttctggaacaatgaggggttgtgtgccatgcgctgaactgtgtccccaggccccaccaattctatgctgaagtcatcatcctcaggccctcagagtgtgactgcatttggagacagggtctttaaagaggcgattatagttaaatggggtcactggagcaggccctcatccaataggaccggtgtccttataagaagagaagatgatagggacaccagtcctattggattaggacacagacatattagtgtgggacaaccgtgtgaggacatagggagaaggtggcatctacaagccaaggggagaggccacaggggaaaccaaccctgctgaccttgatctcagtgtaaggaaataaatctctgttgcttaagtcccaaaaa

SEQ ID NO: 261435 - DNA, 593 bp, Homo sapiens
ctaaactatgccagggcagtcagaaataaaagaggcaaagcataaaggtcattgcagattctcaaagcagattctcaaagcggattctcaaagcggattctcaaattagctcaaagaaatggaacttggtcatcagtttcctgtggaacttgacaaagctcttgttcttgatgctgcctctctcattcccttcagttactactgctctcaggttcatctctcttcaagcttcctacaaaaccatgtttcttcctgcatagctagtgttattgcctcttaattagtcaaaataattaagtccatcaggcataatcttgctcagattcctgccccacttcccatagaggcttgtagggttctggatctcaatactagtaggcctcagaaaagcaagatctctacaaatggaccatgttgtctagaatcttacagtctggcatactttcagcaagcttttatttttaccttgatatgtctttggaaaattgttaacttctattagtaatatccttatacaataaaggttaagggcagtggttctggattcagacaatccttaaagcatagatgaatatacatggaaatataaaaaa

SEQ ID NO: 261436 - DNA, 423 bp, Homo sapiens
gagagtagtaactgggacccagtaggtggccaggtggtttgtatcttggtacaagggtaagtaaaatagttgatgtccaaggctccctttgctttctttttctcttattttcctttcttgagatatattttctctgtaagtgctgtgttattaacatactacattttatcattctgtaaattaagttatactatatgcttttagtcatctttgtggttatatagtgatatgtacaatctcacttaggaaatcaacaattgttgttttttattttgagacagggtctctatcgcccaggctggagtgcagtcgtgtgatcacagctcactgcagccttgacttcctgggctcaagcagtcctcccacctcagcctcctgattagctgggactacaggcgcaagccaccatgcccggctaagttt

SEQ ID NO: 261437 - DNA, 1288 bp, Homo sapiens
agcggaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggggcggagggcggctgcacaggcggcaggcccttcgaggaccccttcgagtacgtcttcagcttccgcgacccagccgacgtcttcagggagttcttcggcggccaggacccattctcctttgacctcttgggaaacccgctggagaatattttgggggggtcagaggaactgctggggaagcagaagcagagcgtctgcaccccttttctctgccttcagtgaatttccagcttttgggggtgtttttcttcttttgatacaggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatt

SEQ ID NO: 261438 - DNA, 1059 bp, Homo sapiens
agcggaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggggcggagggcggctgcacaggcggcaggcccttcgaggaccccttcgagtacgtcttcagcttccgcgacccagccgacgtcttcagggagttcttcggcggccaggacccattctcctttgacctcttgggaaacccgctggagaatattttgggggggtcagaggaactgctggggaagcagaagcagagcgtctgcaccccttttctctgccttcagtgaatttccagcttttgggggtgtttttcttcttttgatacaggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggca

SEQ ID NO: 261439 - DNA, 936 bp, Homo sapiens
agcggaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatt

SEQ ID NO: 261440 - DNA, 707 bp, Homo sapiens
agcggaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggca

SEQ ID NO: 261441 - DNA, 1073 bp, Homo sapiens
agcggaggcggcccaggtctccgagcactcgggcctgcgcctgggtgctggcagccttgccgctcgctgtgccagtgcctggtgggccgttctggccatccagcatggtggactactacgaggtgctggacgtgccccggcaggcctcatccgaggccatcaagaaggcgtaccgcaagctggcgctcaagtggcaccccgacaaaaaccctgagaacaaggaggaagcggagaggagattcaagcaggtggccgaggcctacgaggtgttgtcggacgccaagaaacgcgatatctatgaccgctatggcgaggcgggggcggagggcggctgcacaggcggcaggcccttcgaggaccccttcgagatttcgttcctttggctccctgggaagtgggggcctttcttccttctgcatgtcctacggtagtgatgggacaggcagcttcaagtccatgtcgacttccactgaaatagttgatggtaaaaaaatcaccaccaagagaatcattgagaatggccaagaaagggtggaagtggaggaagatggagagttgagttaaagtccttcataataaacggcatagagcagttgctccccattgacaccaagtaattccagtccacatttgcctttaagcacatctggaggaatagcggactttttttaggattgaaagtgaactttactttcagaacagctgtacccaagaatttataaacactttatgccaacacctgttcttatcgttgggactacacggataggacctctgtttgtctttcaatcgttgtaaaatatctgtatgcaatttgctatttattaaacttaagcctgaggcagacaatgattatttgctagtggtaggacagaatgttcagttcagcactttgagcattacctttttccgttgggaaagtgtgagccaggtggtttgctctaaatcatttgactttattgtttagtgtgtagtggtgaaatctacaaataatatcaatacttctggcttaatttaatgatggttcaaaacaacatgcatttattatcttaatattttggaggtcagacatt

SEQ ID NO: 261442 - DNA, 458 bp, Homo sapiens
tgtttttagataccttttataaatttaagaaagtcaatttttaaagtaattttgttaaaagtttttaattttaaatttcattcagtgcattttgatatattaagataatcttacatatttaatctatcaatgaattaaatcacatttaatgatttttaaaactaatgtatttaatttctgagacaaaattatttgagcataaaacaccatttatatgttgctgaacaaattctgttaggattttgtttaggatttgtatgttatgaataagatggtgctataattttcctctctcatattgttctttgcaagttatagatctcaaactaatcccagtcccttacctatatcaccccttagctgatctaatttttttccatagcacatataactttataacatactatagagtttaactgtttactacagctatttttttatgttgacctctctccaaa

SEQ ID NO: 261443 - DNA, 571 bp, Homo sapiens
caggtgaccagcctggaaggcaccactgctgcctgtggagaagcacatacagcacagagaaggtgggtagcccaattaaggcaagcctttccgaaatgggtcgagaattctgactttgtcccaggaaagtgagaagccagtgaaggtctctgtgcacatgagtgaagagatcagatcagtattttagcctgaaaaggatgttaggatttggaaagaacttctctgctagaaatgcagagagccagtggccataatccagttgtggagtggagcagggaggcaggcagtgattagagcagtgaaaaggatggaaagaaaaggcagttccagaaagcctgggacagaatcaagaaggcttggtaaccgatgaggcataaatggaacaggggggattagatcagaggcttaaaacttgataaatagcaccttcaaaagggatggattttttaccactcattcaatccatgtcacatcacaactctacagaaaattattcagaaaaacatgaagtatttccatccttttaataattaaagatcatagacataaaaaggaagttttctgaataact

SEQ ID NO: 261444 - DNA, 509 bp, Homo sapiens
aataagcttcactttcaaatttattaatactttatgctacttgggtagctagttggtaatttaatgaacataatgaatgctgctgaccaagagctaccttggaactgaaataaaaatgggaatgtataattgattccatattggctaaaggtttgtgatttgaaacgattcaattatacaactgacttacaggccatgaagtttggctccaaatatctatatacaataagatatatctatgaccctttccttcttattaaagtggaaaggtgctgggctgggataccattgtgacacttagaagctttgagaccaggtgcaagttatttttctctttgagattcatattctttaaatcccaaaagacagtactgaagactttaaaacacatcatgaactttaaatattatcattaatactagtagttttatctctactcatcaactaagtcatatttttaaaggttatttccctaacaagtgtttgaaattcagtgtaaggatttttaa

SEQ ID NO: 261445 - DNA, 345 bp, Homo sapiens
gtgatatcactcagcaaaatcatttaagggccaaattggcatctgggtagttttggacaagccccttgaacttctagttataattattgacactaaacctgacttttatctgatttaaataaacttacttcattaataatttattagtatgttgaccatccgtatatttggaaatgtttcctcatttgttaattgagatagtggtgcttacagggctttgtgaaaattaaatttgatgtttctagatatagtaagcaatcaatgtacgctgttgctgctgctgtttctattactaaaactaataataataatgcgatttataccaagttacccatcatgtacgtt

SEQ ID NO: 261446 - DNA, 660 bp, Homo sapiens
tcatggaatattcctcacaatagactatatactaggtcatagaacaaaccccaataaagataaatgatttaaatcatacagaatatgttctgtgagccaagaaaataaatttgaaatctataatggaaagataatttgagaaattccaactacttgaaaattaattcattaatctacatgtctaagaagaaattacagggaaattaaatgatacttttaactgaatgaaaataagatagaaggtatcaaaatttgtatgatgcagctaaaacaatacatagtgagaattttacagcttcaaagtcttatattaaaaaaagaaagtactaaatcattaacctaagcttccatctcaaaaagctgggaaaagaacaaattaaacccaaagtaagtagaaagaaagactaaaataacagaagaactcaatgaaataaaaaataaattgtaaataccaaagacaaatcaaaagttgtttatttaattttctgtcttacttatactgtccttactaagatcagaaaataaggagactacacttactacttctatttaacactgttctggatatactagccagtacaaggcaagaaaaataaataaaagttatttccattagaaaggaagtagaacattttattcacagatgacgcaatcaggtat

SEQ ID NO: 261447 - DNA, 680 bp, Homo sapiens
cggggtgtctccaaaggcagcttgtgcttgtttgtgaccagggtgacaaaggacttcactgtcctgtagcacagatgaggttccaccctcaggtgggtggaaacagcccaggccattagtgcaaatcccctgcctggcccagggccacgttcagcccactgtctgtttgctttgggacccacccaaggtcacattttagcttttgagaaatgtgaaagtggaaaacattgcaaaacaaaaagcccctggaaaactgtgcacacacccatcccctcagcctgatgctccagcttggctgctaggagatcaatgcagctctgccttcctgctccctgtgcagaggtgccggctcctgcttcctggttcccagctttccttttgggaactgcctgaggtggtttgacacacagctgttgggcttctcttcccttgaggtctctgaaccagggcacccatgcaggtaaacacaaaagcggagtggggtggaatgggggtgctggctgtagcctcggcagaaggggacccgcctctctcctcacgagtatccaggatgtgggactggatattgaccagaccagaacccactttgggcccacatgggagctaatgtcagcaggggcctgtggactgttcccattgaacggctcttcctgctagctgtggttctcagtgtggctggc

SEQ ID NO: 261448 - DNA, 321 bp, Homo sapiens
gactcaaaaagctgcttactgttatgttctatttatatgacattcttgaaatgacactacttagggatggataatagattagtggttgccaggagttggggtagtggaaggggtttactacaatggagtggcataaggaaattatttggggtgttgaaactcttaattgttgttacataattctatgcatttgtcaaaattcatggagctgcacacccaaaagagtgaattttatacatccctccacattttgtcattcagcaccttaatatctatgcaaatttaaaaataaacaaataaaagatattagttaacaaatta

SEQ ID NO: 261449 - DNA, 155 bp, Homo sapiens
gccaatgtatgttgatctcatgagggttacaggttagtagagataggcaaatatataaaataaaagatgattaaaaagatgatcaagtgctcaaataagagcatctgtgatgtatgaaggagcataaagtagggtatagtcatctggggggaaaa

SEQ ID NO: 261450 - DNA, 343 bp, Homo sapiens
cgcggccgcgcgacacggtgcgagaagacgacagaagggggagtagcactctgctagcagaagtgagcgcgggtcggctcacccactttgctgctagctcagtacttctccacctccgacggtagtgcctggcatggtgtaggcacttggcacatgggtgttgaattggaggaaggaggaagggttttgttgggtgagtggggtcccgtctttcctcctcaccccattggccctggagagatccccctttcccaccacttcctccttggcatataagttctgtttgcctggagcctaggccctttgcagcccaaaggtaaacaggtttataacgactttagat

SEQ ID NO: 261451 - DNA, 1257 bp, Homo sapiens
agcggaatggggcggtcggaacatggcggaccagatcccgctttacccggtgcgtagcgcagcggcggccgcagccaaccgcaaacgcgcggcctactacagcgccgcggggcccaggccgggagccgaccggcacagcaggaacgagcatccggcacccttgtgcatgtaccctacaatgactgccaggcttggatggatgtccccactcctgacttggtctgccctgacaccacctgggcaatggggagagtgtcttcctacggctggggcgtgtgggagtccaggcttcacgcactctttgctgttcaatgtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagaactgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatgggcattcacagtttcgaaggcacatttaccagggaagacagtgacccgcccattcatgaaagtctcagcatagaaaatacattgtggcagcaccattgttgcatcagtactgtaataggtgtaacaggtagcgagctcgatt

SEQ ID NO: 261452 - DNA, 1085 bp, Homo sapiens
agcggaatggggcggtcggaacatggcggaccagatcccgctttacccggtgcgtagcgcagcggcggccgcagccaaccgcaaacgcgcggcctactacagcgccgcggggcccaggccgggagccgaccggcacagcaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccagttgctgtggttggctgataaatatttgtcgaagaaagaaagaactgaaagctcgcacagtatggcttggatgtcctgaaaagtgtgaagaaaaacatcccaggaattctataaaaaatcaaaaatacaatgtgtttacctttatacctggggttttgtatgaacaattcaagtttttcttgaatctctattttctagtaatatcctgctcacagtttgtaccagcattgaaaataggctatctctacacctactgggctcctctgggatttgtcttggctgttactatgacacgggaagcaattgatgaatttcggcgttttcagcgtgacaaggaagtgaattcacaactatatagcaagcttacagtaagaggtaaagtgcaagttaagagttcagacatacaagttggagacctcatcatagtggaaaagaatcaaagaattccatcggacatggtgtttcttaggacttcagaaaaagcaggttcgtgttttattcgaactgatcaactagatggtgaaactgactggaagctgaaggtggcagtgagctgcacgcaacagctgccggctctgggggaccttttttctatcagtgcttatgtttatgctcagaaaccacaaatgggcattcacagtttcgaaggcacatttaccagggaagacagtgacccgcccattcatgaaagtctcagcatagaaaatacattgtggcagcaccattgttgcatcagtactgtaataggtgtaacaggtagcgagctcgatt

SEQ ID NO: 261453 - DNA, 420 bp, Homo sapiens
taccacatcagcgagtcttcccacctgttcctacagaagatatcctttatcagccaacatatccagatgacaactgctgccagcctggtttgagccaccttgaaatctcatgggaacgctgagaaataatcaaaatatttaacaactgctaatggcacagcatggtgccaaccaactgcatccagtcagcaaatgttggccataaagaatccaggccacagtaccagtatttgccagctaaatattagccctgcacctgcactccaatagcttatctggtctcttccacaagcctctctgtaatcatctttcatacaccagtcagaatgatcttttaaaaatgtaaatcagactaagctacttccctgcttaaaaccttccaaaggttttcttcccatttctctcagaaaagaaaaatta

SEQ ID NO: 261454 - DNA, 383 bp, Homo sapiens
ctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatgg

SEQ ID NO: 261455 - DNA, 1038 bp, Homo sapiens
ttaaagtctaagacaaaaactcacacctggaccaggctgactctcctggtgtaaagcaggaagatgtgatgaaaactagagccaggaatgtcaactcgcactttagtctgggatgcttgtgtggtcagtttcgcccacagaaccccaaaagaaattacactgagggctacatcctgacccctttccccagtccccagggtcacggggcagaaacttctctcccacacaccaagccccaggccagggccctgggaaacctcccatgtcctcgtcccacctgccccatgtggttgtcactgtttctcccatattagagatgacagaaccaagactcagacaagggaaatgcatccaatccaaaggcacagaaatgatggtggagatgcaagtgctgcatcccaggtctagctgactccaaagcccatgggcttttttccagcgtttctttctgcacttgaccaaaattgggagactcctggtgatggcaagctgactgtctcctgcggcgtttcattgcgtctgtcaagtttcatttcaggggatagggatgcagcagcacagattcgaaccttcccaaatctccaataaaaacagacagaacaatgagaaggcaaaactaaacccttagacaacctcaacagcaaatgaggtgacaagctgtccccaaactacaaatacaatcaggtggcggagggcaccaaatacaagtacctgtgtgtcaccagcatctgtgtagggcacagcaagggaagctccagggctctggcaggctggagatcagggaacagcaaagtagccaacagatgctcagaggcaaacatgacaaaccacaggactgtggcagaagctgagaggagtttctaactaaaagcaggtgatgtcaagaagtctagtctagggtaggctgacctccatagattctccagaatgaatgtccagggcttccttccagggcagggcccttgctgacagcagattcaacactgagacaagagggatgacagagacaaaggaagagtgggaccagataacagggag

SEQ ID NO: 261456 - DNA, 5992 bp, Homo sapiens
aaattgctgtgaccgcagcatctctaggaagacgctttattcctgaaggacactgactgtcacttgggaaccaagaagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagttggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaatgagactgtggtggggctgtaccagaagtcttcgctgaagcttctctccttccttttttccaactatgctggtgcagagacaggtgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccaatacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgatctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgaaaagcagcaaatagaagagaaattgaaaaagaaggagtttgaactcagtcagttacaagccagaatagatgacgaacaagtccacagtttgcagtttcaaaagaagattaaagagctgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagatcgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaagaccaaatacgagacggacgccattcagcgcacagaagagctggaggaggccaagaaaaaactggcccagaggctccaggaagcagaggagaagacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagctggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaggcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccgcaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcgg

SEQ ID NO: 261457 - DNA, 1088 bp, Homo sapiens
taatgtaaatagtaatgtgatgaacatccttatggctaaatgtttgtgcacataaacacaatggtattcttatgtgtaaagttgttggtccagtggtacacagagcacactttagaaacaaaaatccatcagaattgccagcacattgcttaagagtgatttgagttttacttcctagtgttgctcctagcaaaggtggggacccgccgcagaggcagcctttggcccaggtaaccagtctctgggacatcagagaaggacctcatgtagcttgccgtgctgccttatctggctagtctggcaccagagtgctgggactctgcccctcgtcctttctccactcattcttccaacactgcttgagcagtgggccctgtagggacttaatacatattaattgacagattcagatgcttttccctgtgtaagagctcagtagtggagacccatttgtctgaatgctttttacgtccctgaaaccttgcatgagaggcacagattggactacagagacaatggggcatcagggaccttgttcgcaagaaggtttctgtctctgcttttattgcctggatcatgcctgactccaaaacgatggctggtattctcagaaggtgagtatcagggcgggggtttatgggcaagagcgattggtggcattctcccccgcacctatcttttgcccaagtagatcattttggaaaagaactggcttatggaggtagactaggattaacccttaaaaaccagctcagactccagcagcaaaggaaagaggcagccctacttctggcctctggtatgcgtggcactgtatcagatctttgcatgctacttcaggtgatccccatgagaacccgcagggtaaataatagcacagttccctttccagcacgagggattcggaggctctgagaggcttagtgccatgaacagtgtcactcagttgtaaatgggagggggaagtactgagactggaagccaggtttgtctgaatccaaagccacttcttaccaagctttcggtccaggaagattgaacgcttctaaagttttattagaattcaatcagaatggtttcaaagtctt

SEQ ID NO: 261458 - DNA, 406 bp, Homo sapiens
ggccaccatttccatgcacgtgtctcttggcgttgctgctgtttacactatgtggaagctggacactcagcctgtttcggggggacccaggctaaaggttctgccctaggtgtggtaagtatctattgatgcgtagtgtgaacacagcctttgtagcttccccaccctctgcgtggggaatggatagctctgattgcaatcttccttccctagcagcctcttccttatcctcctgggttcagcttcaacgtcacatgcccagactttcagcctccaggacttataccagcacccactctccctcctgattcccagccttcagccttagactgggagttataggattggctctcccagtaaagggtgagatagatgtattcttttatatataatatataacacaatg

SEQ ID NO: 261459 - DNA, 765 bp, Homo sapiens
tttcggtataaatagctttattatgttgggtacataccatctgtctttgaaagcattgaaactttggtaaacttttcttttaggtatttgacaccgaaatctcagtttgggtcagcctcacactctgaagctgtacaagaagtcaggaaagactccgtatctaaggtatgttgatactgaagatgttctgagttttgctggttcattaatgctgtagattagtgctatccatagttttctaccttttaacaaaagcccctatagttaatcaaacaccctgtctgagtcctcttaggctcacctagagaaaaagcactttttctccaaaggaaactacaattttttaaataaatatactacaaaaagcaaagtttttctctaagagagtgaatattttcgcctttgcagttagtgtgatctgtgtcacagcttctcagctacgctggtgtagtgtgaaagcatctatagataatatgtaaacacatcagcttgaatgcattccagtaaaactttgtttacaaaaacaggcaggaggctggatttggtccatgagccatagattactgatccttgacctatgtaatccaaactcacaaaactgaataggttatacctggcaccagcttcacttagaatgttacaagatggagctgaatgcggtggctcacgcctgtaatcccagcactttgggagactgaggcaggtggattatctgaggtcaggggttcgagatcagcctgaccaacatggagaaaccccatctct

SEQ ID NO: 261460 - DNA, 1940 bp, Homo sapiens
ttttaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttcctatcatggaatcttcatccatgtgtcattcatgctgctctctaggcacactcattgtccttaatgaaggtctgtgtgattgtaaggactgcatagacacatgagcttctgcacagctcagcggtaagcaggggtcccctgtcgtttcccttcttaataacagatgtgtattaagctttacaattcttagagatatcttaagctttggccaactccaggaaatcttcaagtgccattgtctttccaaaaactgcatgttttatggcctttgctcacctttttgtcgtgactggtaatcaaagcaagattatactattctgagtgattaaggaacccatgcagggtttaaaatccattttcttgctattgtccaatgtttacagagtactcaaaaggttttcctaaagtaatctaatttccatctccaatttaattcaattttcagcattgtagcatttcctttggtgtttgttttttttttttagacggagtttcattggtcggatccagttgggtggggattccattaggggggggat

SEQ ID NO: 261461 - DNA, 518 bp, Homo sapiens
atggaatcttcatccatgtgtcattcatgctgctctctaggcacactcattgtccttaatgaaggtctgtgtgattgtaaggactgcatagacacatgagcttctgcacagctcagcggtaagcaggggtcccctgtcgtttcccttcttaataacagatgtgtattaagctttacaattcttagagatatcttaagctttggccaactccaggaaatcttcaagtgccattgtctttccaaaaactgcatgttttatggcctttgctcacctttttgtcgtgactggtaatcaaagcaagattatactattctgagtgattaaggaacccatgcagggtttaaaatccattttcttgctattgtccaatgtttacagagtactcaaaaggttttcctaaagtaatctaatttccatctccaatttaattcaattttcagcattgtagcatttcctttggtgtttgttttttttttttagacggagtttcaaaatttggattcatattcatatgtggg

SEQ ID NO: 261462 - DNA, 192 bp, Homo sapiens
tctacttaatattttggaaaattatttttctgtaaaacactgaagtgctaattaaatttcaacaaatttttttaaaaataaataaagctggtcacagtggctcatgcctgtaatcccaggactttaggaggccaaggcaggcagattacttgattgcccagcctgggcaacacagcaaaactccatctctac

SEQ ID NO: 261463 - DNA, 278 bp, Homo sapiens
tcttccaggaagcccccccgtgagtccagctgccactgtgtcccctgtcaaagcttcaacctctgagctgtagcttctggggcacacattgaccaccccccaccaaacggaggactccccaggggctcagggccagctgcccatttgcgaccatgccctcagcccgcagcacagagcatacacacagtgggtgcttaatgaatgttgttgtatgaataaataaatgaaatgcaagcgtctggcacatgacaggtgctcaatcagctcttgttaagtga

SEQ ID NO: 261464 - DNA, 411 bp, Homo sapiens
agtgttgggattacaggtgtgacccaccacgcctggccaatattctttaaagacaacaatatccagatacttaatgtagcacttgtaatgtctagcatgcaataaaaaattactagatatgtgaagcagaaaaatactgtaattggggtgggggtgaatctgttaatagaaacagacccagaaatgtgatagataagagaattagcagacaagttaacagttaacttaaaatagttggaataaatatgcgcaaggatttgaaggaaaatatgaacataataaggtgagaaaatagaagatataaaaaaaaattcaacagatgagcttaacgacagattggagactacagaagaaaataacagtgaacctgaagacaatagtaacacaaactatacaaaatgaagcagagag

SEQ ID NO: 261465 - DNA, 203 bp, Homo sapiens
gtcaggcagcactggtgctcatgaaaaatattggagaaggggactcctagtccccctcatccactactgcaatcacagctggggcttcttccatgacagctcagtttgggtgtacctgtagtcagtagtcagcctttctagaacacttcagggtgactgcatctccacaggaaaagtgttctccaggttcaggtttgcacaag

SEQ ID NO: 261466 - DNA, 559 bp, Homo sapiens
ctgatactgcaagcacttcagagtatgtataagcaatttcagctggttccgtcctgatatttacaaaactgcctggatcatacttacaaccatgcaatgatatatatttctattaagaaagcaacgatttgcttgaaagatgaaggaaaacaaactaagtatttatgtacaatgagtcctaagtgtacaccactatgttttccatcagcttttgattttctgtcactcctctttttctttgaaatttagagtcagaagtgaactgacttcatggttttcctcatgattatttgatatcctctagggaatcatgacttaaagactgcattcttccttctcaaaactcatgttaaagatttctccatgcagagccacaggctattttggagtttgaaatggagcagttaaaactaggaggtcacacacgttgagattattccttcactgcatctcgcccggcttgtgtgcctgaggagacacgcatctcagagggcagaggggcagccgttgtctagtgaggttatttcacctactatataataaaatgtacaggacaata

SEQ ID NO: 261467 - DNA, 457 bp, Homo sapiens
agcccagactggtcttgagctttggcctgaagtgctcctcctgccttggcctctcaaagcattggggttacaggtgtgaagcactgcaccttgcctacacattttttccaataattttttttattaatttgtaagagttaacatgtcgactatcatatataacatagaattgttcccattttgtcatttcctttcaactttgtctatgtagctttttttctgtgtgcaaattttacatttttaggtagtcagaaaatctcttcccttgtaattttttctgctactagaccaatgtttagaaaaaagcgtgcttccccacctcaaaattataaaaatagttacttgttctttttgagtactgtgtgtgtttaaatctttaatctttaaatttaaatctttgatccatctggtatttattttgatatgaagagagtggttgggatctggctgtatttct

SEQ ID NO: 261468 - DNA, 588 bp, Homo sapiens
gagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgata

SEQ ID NO: 261469 - DNA, 1208 bp, Homo sapiens
  misc_feature (42)..(42): n is a, c, g, or t
cgcagcgcaataaaaaaactaggctaggtcgaggcctggtgntgatacagatcattgcactggaaaatattcccagcagtaaacacttccattaatgtgatctacagcttttaaaaaggagcatctcagaataagatggtggtacaattgcttattgagaaaggaaaaaaaaaacacacgagtatattacaaagggaaaagaaggaatgtgatttctcatgattgaaagcttgatttagattgcatacagcttttgctacccaagaccaagcggctctggcaagacagggtggttttccgaatgccagaccgaggtgccttatgaaggcagctgccgatggttccagatgtagagagataggtgatgcaggagggaaagctggattggaaaagggagagttttgtagaccggctacactcattgtgcctttgaaagagcagagccggcagcctctagtcatcatttggatatacaggactagagcatgaatctgatgtagagctacagaatgaagagcaacagcagctgtttaaataccgagaaagtgtgtagaatgaaattggacaagccaagcatggtggtttcatgcctttggtcctagctacttcggaggctgaggtgggggaattacttgagctcagcagtttgagtccagcctgggccagatgttgagaccctgtatcttaagaaaagaaaaaaataagaccaggtacagtatctcatgcctgtaatcccagcactttgggaggccaagttgagaggactgctcgagtgtaggagttcaagaccagactgggcaataaagtgagacccatttctttttttttttttttaacttcttaaatgcacaaatttattttttctcaacaaacacacatcttaatgcctttacaacttttatctccccaaatatatcttgcttttctttatatgtgctgtatacagagttgttttccttatatttagtagttattgcttttttgtgcccttttgcgtcctgaatttacacatcaggcatagatcttgggacaggaaagagctgtgaagcaaattcctggaaaatcaaaccccttccagcatggccaggtagcacagctgagccagggatgatggggccatattgggtttggctctgccttgcagctggcagtccaaacactgaggacatgcatatttctgcaggccagtgagacccatttctaccaaa

SEQ ID NO: 261470 - DNA, 424 bp, Homo sapiens
tactaaaaaatacaaaaaattagctgggcatggccgggcgtggtggctcacacctgtaatcccagcactttgggaggccgaggcaggcggatcacgaggtcaggagatcaagaccatgcctggctaatttttgtatttttagtacagatgaggttttaccatgttggccaggctggtctggaactcctgacctcaggtgatccgcccaccttggcctcccaaagagctgggattacaggcgtgagccaccgtgtctggccatacacatccctgccgaagcccgcattacccttcccctatgctatagaagccctgggtcgggggggtgggggtaatggcacagggatccaccatcttatcttggtgccatccctgacttggcttctgttcataaatgcctattaaatgtttctttctgagaaac

SEQ ID NO: 261471 - DNA, 940 bp, Homo sapiens
  misc_feature (42)..(42): n is a, c, g, or t
cgcagcgcaataaaaaaactaggctaggtcgaggcctggtgntgatacagatcattgcactggaaaatattcccagcagtaaacacttccattaatgtgatctacagcttttaaaaaggagcatctcagaataagatggtggtacaattgcttattgagaaaggaaaaaaaaaacacacgagtatattacaaagggaaaagaaggaatgtgatttctcatgattgaaagcttgatttagattgcatacagcttttgctacccaagaccaagcggctctggcaagacagggtggttttccgaatgccagaccgaggtgccttatgaaggcagctgccgatggttccagatgtagagagataggtgatgcaggagggaaagctggattggaaaagggagagttttgtagaccggctacactcattgtgcctttgaaagagcagagccggcagcctctagtcatcatttggatatacaggactagagcatgaatctgatgtagagctacagaatgaagagcaacagcagctgtttaaataccgagaaagtgtgtagaatgaaattggacaagccaagcatggtggtttcatgcctttggtcctagctacttcggaggctgaggtgggggaattacttgagctcagcagtttgagtccagcctgggccagatgttgagaccctgtatcttaagaaaagaaaaaaataagaccaggtacagtatctcatgcctgtaatcccaaagagctgggattacaggcgtgagccaccgtgtctggccatacacatccctgccgaagcccgcattacccttcccctatgctatagaagccctgggtcgggggggtgggggtaatggcacagggatccaccatcttatcttggtgccatccctgacttggcttctgttcataaatgcctattaaatgtttctttctgagaaac

SEQ ID NO: 261472 - DNA, 415 bp, Homo sapiens
gactgcagtggcacaatctcagctcactgcaaacttcacctcctgggttcaagcgattctcctgcctcagcttcccgagtaactgggattacaggcgcctgccaccatgcctggctaatttttgtatttttagtacagatgaggttttaccatgttggccaggctggtctggaactcctgacctcaggtgatccgcccaccttggcctcccaaagagctgggattacaggcgtgagccaccgtgtctggccatacacatccctgccgaagcccgcattacccttcccctatgctatagaagccctgggtcgggggggtgggggtaatggcacagggatccaccatcttatcttggtgccatccctgacttggcttctgttcataaatgcctattaaatgtttctttctgagaaac

SEQ ID NO: 261473 - DNA, 333 bp, Homo sapiens
tgtagacaacgccttgctgtgttgcccagggtagtctcaaattcctgggcttaaggatcctcctgccttgccctcccaaagtgctaggattgtaggtgtgaaccaccatgcccagccagaacccacatattcttctttgcctgtattccaagtgaagagcatcaggacatgctaccctaaaatatgccactttgacataagaattattttgagctgaaggcatttcattttctaaaacccctaaaataagtcaaagaaactcaattgtcataaatccccttcccaggaacaattctactcttctcagagaggagtcgccagcacacccaagca

SEQ ID NO: 261474 - DNA, 514 bp, Homo sapiens
agactgggtatctcctagagattcctgacccccacgcaccagccccaccaccagagggcgcccgagcacagagacgccgcaaccggagcaggagccctaaacctgtcagggtgggtcagccctggagtaatcctggagggagggtctgggagagggccccagtgtggggacctgcccggctcaaccaaatgtagtttgttaccttggtggccatctgcagccaggtggccctgccacactgctaaaccagaggatttaggaagcagacagggattcgggaagtggctgaagagcactggaaagacaaactcctgcggtgcaagagtcctggaccaggagtgcggagaactgggggcgctcctctccctgttaccctaggcttgttttctcatatgtaaacaaaggcaggggcggggagaagggaaggactcgatggtacccaggtgcccttcaggctctaaccaaagacatgccccaccctcctggaggaaccctgcggagcgccctgaacggc

SEQ ID NO: 261475 - DNA, 437 bp, Homo sapiens
gtcctttctgggttggcactgccagcctcaaagccccctgggtgggaggaaggggctccccctcaggaagaaggcagggtgagactcctgcccctcacactctgtggtttccttccacactgcctttttttgaagctgttgcccaagggtaaacaaactctgctccttgactccctttagcccagtgggggctggtagccttttagcctggtggctaaccaggagtttgcctaagaggccctgttgggcttagaacagaaaggcctctggccctttctacacatgtgactttgggattacaggcgtgagccaccacacctggccaaaatattcttgataaaatcattgttgaattcaaatcaaatcaagctaccagcctctagggtctacacttgattaccagcttagggaaatatgggggtagtggagcacattta

SEQ ID NO: 261476 - DNA, 468 bp, Homo sapiens
ctgcctcagcctcctgagtaactgggattacaggtgcccagcaccacacctggctaatttttgtattttttgtagagatggggtttcaccatgttggccaggctggtcttgaattcctgacctcaagcgatctgactgccttggcctcccaaaatgctgggattacaggcatgagccaccacacccggccaaattttgtaattttcatttctattgcttcattgacctccatagcagccttgagaaaaaggcattgtttatcctcattttatagatgagaaataacagagaacatgggtaacaaatgcagtcaactcatctaagaagttccaaagcctgagtccctgcatttctggttgctgggtgactgttttccccacaatactgctctgcacctcttacaaataaatacttgggcaactccacttccggtaagaaatacttggccagggagccatagctgtgagc

SEQ ID NO: 261477 - DNA, 699 bp, Homo sapiens
cttattcctcccaggataagtaagcccatctccctttcttattttttatggactttccccagtgaaatacaaaccccaagagagcaggagaggggtttgctgcattcccttggcatacccagagcctattgcagtgcctggcacgtggtcgtgatggaacgaagcactgataaatagcaggctggtggggttgccggatggatggaaggagggaggttctacacacagactcaggccctcagcctcctctggagggagggaggaggcacgctatggcatggccccattcctatggcagccatcctgcaacagctattcaactttccacttgtggagtgaaagcatgaagtttaattccaccagatgactaatgtcctaataactttggtaatatgccacccttataaactgcctgcattctccagcaggatcccaaggaagcagagataaatacatatatttagggaaaattgacctttaaaagtcaaggttccatgggccaattcccaagtcataaagagctcatgtgaaaagtaacctttagtttgccatcaaaactggtttcataaagaaagcgttttaaatatacatttgggagtttcacaataggttccttttacactgctgatctgtgacatgagacaaggcttgccaagattttcaataaaaaaggatatattgatctaattaccttctatt

SEQ ID NO: 261478 - DNA, 865 bp, Homo sapiens
gaattatgtaattttttttcctctgaacacatcccatgttttcctatagacatgcctttgttttctctcataactctatcactgtctgttgcaattctgctcctcacctgaagcccatctcaaatactatctcctttaataaagcttttgctgatcaccctaactagaaatggcatgttcagtctctaaatatctcctatggctttttacattaaacttatgttacagttacttattcacatttctcctaaatttgactgtaacctttttaaagcagaggctgtgtcttatccttataactactggagctcagtaggtgcttagtaaaatggctgtggaataagtgagtaaatggaccatttgcactagggttggcagagagctggtggccaggaccaaaattttatttaggtcaaaaattttatcctggaacacaattgaataataaaaaaacaaaaatccaatgaaaatgggcaaaaaatttgaacagaaactgggtaaaagaaaatatacaaatagctgacaagtgcataaaaagatgctcaacatcattaataatcagggaaacacaaattaaaaccacaatgagagacccattagaatggctagaataaaaaaaaatgacaattaaaagcattggccagtataaaatgctcataccttgctggtgagaatagaaaatgagacaacccttttggaaaacagtatagcagtatttcctataaagtatacataaagacatatatatagagatataaatctatcctattacctgttaattttactactaaatttttatattagaaaaatagcatgtctatgggaggtggggtgaggcatgagggaactttctggataatgaaaa

SEQ ID NO: 261479 - DNA, 202 bp, Homo sapiens
atggccaggagcccctacaaatgaagagcagcagggccagttagtttggaaggggaggtggagtccagggaaggccgcagagctccaggctgtggaatgcacgtgccactgcagaagggtttccaggccaggagactgcccaaatgggagagacacgcattgaggtgttattaaaattcacctaattattctggagacacta

SEQ ID NO: 261480 - DNA, 219 bp, Homo sapiens
ctatggatttattttcctgtggtcaggtctggaccaaagagaaacaagaaaagctggagtcacactaccaaaggccgaagctgagcaacagagctctggagtcagctgcctgggttcagcatgcagcgctgccgtggacgatctgtctctcttgcatatatgacttaccagttttactttcagtctctccatttctaattaaatgagatgcagaaatgc

SEQ ID NO: 261481 - DNA, 209 bp, Homo sapiens
gtctccaaacacagacaaaacgtaaatattgtccaagaaccgagataccaaacattccctttcccagctgatgtgaatgactactgcttgtttaccagttacagcattagcctccccctatattttagatttattgagtggtaccatcatagaattaaccccacttctaacagtgttcaatcctgagcaaagctccacttcctcaaatt

SEQ ID NO: 261482 - DNA, 651 bp, Homo sapiens
gtacataccagtttcttttcaatctgccacagatcaatacttttgtaatatacaacaagtcaacagactctactactctgttaaatagataaaggatttctaaagaactactcttaatttctgtacgtaccatttctttgacaactagcaaaatgagacctgccgctggtccatgaaacacactttaaatagcactgctatgtggctagaaagctgaatactacatttcccagacttccttgcagccagggttttgcatgtgatcttcctgtcaatcagaaatacccttcaatatgaagaagtgaaaatgaaaccataagtccatggacacatgggagacagacgaatttctggcaagtatatcccaaatacagcagacaaatattagataatatcactgatatggtttggctatgtccccatacaaatctcttcttgaattgtagctcccctaatcctcacatgtcatgggagggacctggttggaaggtaattgaatcatggggcgggtttttcctgtgctgttcttgtgatagtgaataagtctcaagaaatctgatggttttataaagggcagttcccctgcacatgctctcttgcttgcctccatgtaagacatgcctttgctcctccttcaccttctgccatgat

SEQ ID NO: 261483 - DNA, 286 bp, Homo sapiens
catcaccccccttcacacacacgcagtgacatgtgcttaggcatgagaaagccgaggcctttggtataaggtagagagtgagctgaacttgctgcactgggctactcagacagttctttgtcagttgcagctatacttgttcatcaggaagcctccctaccaccacatggtcttctccagttatgttagatgtgtatgtgtaccactttctggcattcatgttttaaattttagagaaatgctaaacctcatccagaaagcctgaaaacctcattctcactatgct

SEQ ID NO: 261484 - DNA, 636 bp, Homo sapiens
ctaaggcctaaggaaagcagccgatggctcccaagacaactctgtccggccagtactccagggcaacttcaaccccactaggacccaggccaaaaccatatatatatatatatatataaattaacgcaaaacagagccactttggtgcctacccctccacaagtaggtaggcacatccaggtagctctgtcagaagatgggacctggcgccttgcaggggtagccctatggagatccagaagccccgtttcgagctacgaagtctctcttctactgcagtcttctctccaacgtggagatctagcaacttccctccccctgggattccctgtgaatccactctagttgggatatagcctctctacagctcagtgacgtagcgcgccaaaaccaagtacccaccccggcaactggaagacctagctgtcctccatcccgcctccgcagtcgataatctccaggatccaagcaaagtgcctgtccacgttgtcaccagatccacaagcgcttttgatgagagctgctacccttttggaaacacgattccctctccctagtagagaagaatctattcttctgggctggcgtagacaaagaataaccaagataaagtatgtggtgtgaaaatatcagctg

SEQ ID NO: 261485 - DNA, 479 bp, Homo sapiens
ggctgctctgaggacagtacaagcagcaggggcagcactggagagtgtggccattgttttttctggcagtggagcccctctgctgtgccaggctctgtgtccagcacttgttccgggctatgccctaggggagtaggagtcacatgactatcctagccttggatttgactttggcctcatccacctagagggagtgagcacccctttctcacaggagccaagtggaaccctgggcccctcaggatgacttggtagggcgggctggttgtcactcatgttgggttgggtccccacctgccgtggcccttcccccttttctctgctccttcaccttcttccctaacgctgactgcccactgccaggcctttgtgcattcttggttctcctccttccagacagcctccttctccttcccgctggggacaccccaactactgtctcctggaaaccaaaaataaaactctaaccccccagccat

SEQ ID NO: 261486 - DNA, 446 bp, Homo sapiens
ataagttatctttatggtcccttccaaatagacttcctgagagtctataattctagttatcaaattctttggactaactagatgtcttccaaggaagcttttcatactgatatgctattctttggaggcgtttgatgaaaaaaggagagaaaccagacattagtctctgcccaaagtataaaatgtttcataaatgtttcaggctacccaatcacaaccttaaaagagtatctccataacttctagcacaatctaatccactgtatggctgtctactgtgttctcacagccctgccgcaggtatggaagcctatgttaattttagaagtcacagaatcctcaggtctttgatgagctgcacaggtttagcaaaactgagttgccagagagagagagagtgagagagaagaagacagatattaaacatggattttaatattgtaaaa

SEQ ID NO: 261487 - DNA, 232 bp, Homo sapiens
ccatcctgcttgaactcatgccacaggccatggggatcaccacctaaagactgaaaacggaatctccactcagtattcccgaacatatgaggagacgggagaggcaaaaataagtataagggagaaagaagagagtaaagcagaggctgagaaaaaaaagggtagggttatgttcctggcatccacttgggaactctgaatacattctcctgatacagtcagctagaccagt

SEQ ID NO: 261488 - DNA, 339 bp, Homo sapiens
agcaggaaatcagggacttcattctgtttgctgctgtatccatggcagatacaaccataactggcaagagtaggtgctctatagatattttttgaattagttcaataatttcaatatgggctctgaaattaaattattctgttcatctaaaaattaacaataaattcactccaagtatttgatgccatataatctacatgaatggaggctcaggagttatcatttgctattgcttttcattgctacaaaatcttatcctatgctatgataagaaagttcatcaaatttatcttgtcttctctatgagaaaataataaagaaaagcctgacatgcaaaaa

SEQ ID NO: 261489 - DNA, 293 bp, Homo sapiens
attcggtttgtcttttatttttgttagtgatatggaggtttaaaatatttatgcaggctaatctattgattgtcttttgcacttgcggttctccaactttcctctgtctatactaaaatgaacccttactgctctggaagtctctattctgaataatcagtgtttaaaattatatcccaaagtagggtatcacagggtttcctgatgaggataaatgggcctgaagtgcttatgggcacccactatgtatcatgggaaaacttgcacgtgtgtgtgtgtgtgagagagagaga

SEQ ID NO: 261490 - DNA, 340 bp, Homo sapiens
ccagcaaacgagagttctatggcaagactcacattgggtatggttggcaaggtcataactatgggttaaaggtatgactgctgggagtggttagcttgcaactagaaacagaaaaaaaaaaaagcatataaaggcactggttctgggatttgacagggctgagttacaatcttggcttcgttactatctagctctttgactagagttaataatttcactttgaatcagtaaaatggaataataataatcaattactgagttaagggacagttcagccctttcccactaattgtcccaaattaaaatacaatctatattaatacattgtgctatcaatgca

SEQ ID NO: 261491 - DNA, 623 bp, Homo sapiens
tatcttcatttaaatagaagacacacagagaaaataaagaagcatggaaaagacaaggtgtcatggactgtacgtttgtgttccatcaaaagtctcatgctgaagccttcaccctcaatgtgttggtatttggacatagggcctatgggaggtacttaaggtgagattagataatgaggatggagccctcaccatggcattagtggctttacaagagaaaaaggaaaagggatttctctctctctctttctgcgtccatgctcttgcagcaaggaaaggctatgtgaggacacggtgagaaggcaaccatcttcatactaggaaaagggccttcactaggaagctccagcagcgtcaaaaagaaatgtcttttgtttaagacaaaagatgtaaagtgtgacatcaataatataaaagggggtttgagattaagtaaaagggcagatattttggatgcaattgaagttgttataagcttaaacttaaaatggactgttacaattataacatgttttcatggtaaccctaaaaaaaaactgtagtaaatttataaaatataatgaggaataaatcaaataccactacaaaaacaatcaacaaatcacaaaggaagacagcaagac

SEQ ID NO: 261492 - DNA, 376 bp, Homo sapiens
cttgtccttcatacattaactaatcaagtaggaaaatgcaaatgagaacacagtgccaaacataggcaccacatggaaacaagtatgaggctgtcaggaagccatttttgtagctttgtagcccaattatatttttcctaatgtattgcacacaaaacttgggggttcatcctatcagaggaggaactatgtaaaacaaattttattgattgaatgtcctatttaatcgcaaaactgtatgagaacacgcttgtgacttatttagcagcttgtttgctttccactggcttcacgagtgtcctctggaaaaagaaagtacatttggaaccctgtacaccttttctttctccagtaccctcttctcacttccatcact

SEQ ID NO: 261493 - DNA, 264 bp, Homo sapiens
ccaacttggtagctcaacatagcacagctttattccctcctggctctggaggccaggtgtctaaaaggccatgctcccacaatggttctgaggaggatccttcctgcctctctggcttctggtggctccagcatccctgggctgtggctgcacctccccatgtcaacctccgtcttcacaaggccttttcctgtgtctctgcaaccacaggcccctctcctttctcttaataaagataccagtcattgagtttgaaaattgcta

SEQ ID NO: 261494 - DNA, 686 bp, Homo sapiens
ttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcaga

SEQ ID NO: 261495 - DNA, 267 bp, Homo sapiens
gagatttgtgagtgatgagcagatagatggaaatgaagtcatgtcaatatttaccccatgagagagtctatactgtgagagataaaaagggcttaaaacagagccctggccaggtgcggtactcacgtctgtaatcccagcactttaggaggccgaagcggcaggatcatttgagtccaggagttcgagactagcctgggtaacatagcaagaccttgtctctacaaaaatacaggaatcagccaggtgaactggcacatgcctgta

SEQ ID NO: 261496 - DNA, 482 bp, Homo sapiens
gtttgaagattttagttttcaaaggaaatatgattttgcctatggatatacaatgattacatttaattggaagtttaaactgcctcctggacatggtagatgccccatgacattgaacaaacacatagggaggttaggctactggctgggataactgcttctaactatcaaaagaatactgggcttgctgctacaaagtgggaaagagataaacaaggtttgaaattcatgtgttttttttttggcatctcttattacttctatatcaagtattgaaagtgggataaaaacttaagatgactcagtattcaacacagtaaaaatgaagacataaatcactccattaagacccagaacaggtgaagtttggactgaggtcatgaataatagaagaagaaaaagataaatataaactatgactttgtgacatgttacagaaatgagaatttcaactgctataatttttttttgcttgttatata

SEQ ID NO: 261497 - DNA, 312 bp, Homo sapiens
gtcttatttcaaatgtcgaaaaatccaaatttctgctgtaaaaccctaatatctgcatttttaatcaagtatgaggaccttcatgaggatgggtatatttgtctttttattcacaaatgtatcccaaaacactagatcacttcctaaaaacaccttaaaaatatatggttctctgtaaatatttattgatgagtgaacaaaccaaagccttgtaggattggcttagtaggatttgtttttgtttcttttactaaattatagcagaaaacagtgacaggaaagaggagtctttaatgggagaaaggcaggcta

SEQ ID NO: 261498 - DNA, 422 bp, Homo sapiens
gaatttggtctcatattcttagtgcctaaaagtaagcacaatctgtcatatgtatcttactaacttcgaagaaatctctaattttctcacaagtaacaactatttctctttctagaattttattgaataaatattcatatgaatcttaatatagaaggtacaaggcaatgtagtgctcaatattttcaattttatcacttataaattgttataaatttgtgatatatcttgccacagtctctgtgacaggacaaactcaatgaagacaattttaacacatgggtatgaagggaattttgaggcaatgaagggaggtgaaaaaatacaacacaaataagagtgagtttatataaattcagcctaagctaatgtaactgagaaaagtcagagggatatgtggatttacattcgttattcaattg

SEQ ID NO: 261499 - DNA, 990 bp, Homo sapiens
ggcacgaggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaaggaaaaaaatatcatggacctgtatgtggagaagaaagcacagaagccctttctctttttccacaataaagaaggctccacttctgtctttcagtcagtctcttaccctggctggttcatagccacctccaccacatcaggacagcccatctttctcaccaaggagagaggcataactaataacactaacttctacttagattctgtggaataaatccagcctaggctgtgggtggctggttccaggatagagaatcaagctgtcagagtcatcttaacagatcattatgcgactgagttcactagcagttcagcccatccatagcttacctcattcttactatccaaaagccacctcctcctccaaacatccatttctgtaccaagaccctcactcgaatgtcactatcccaagatgaaacctaaaaatcactttccattctttcttgatcttaccccaccatccactcagctgccatgcccagtttagtcaaccccccaaatgctgcttcatgcaaccttccattcctattccttttgccaacccatgatgtagagatgtggattcatgacattttgttcatacaacttcttcaataaaacattataatatgtgccc

SEQ ID NO: 261500 - DNA, 1189 bp, Homo sapiens
  misc_feature (918)..(918): n is a, c, g, or t
  misc_feature (980)..(980): n is a, c, g, or t
ggcacgaggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaagcttcagggctcccaagataacatagggaaggacacttgctggaaactagttggaattcacacatgcataaacctggatgtgagagagagctgcttcatgggaacccttgaccaatggggaataggagtgggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtcggagtctttttaggagtagatttggactacataacctgtaaatgtgttttgtccagtccttagagtgttttttaaaaaattgtaaagtcaaggttttcatgaaaaatgggaagatcagacaacattgntcctgaattcccacagagcagcaagctactagagctcaatctgttatttcttttcctgatgnacaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgt

SEQ ID NO: 261501 - DNA, 453 bp, Homo sapiens
atcctcactggtctccttgttcttacttgaatgggccaggcatattcctgactgattgcctttgccttaaccagttcttggaaagctctttcttcagctatcactgcagctaccctccttcaaggccccttttcattgaggcctactttgactatttaaaattgcaattgccttactccaactgcaacctgcactttctgaatggcactcctgatctccttgtcctgctgcattcttttcctctaacagttgacaatttaattatatttcttggttattgtttgtctctctacatagaatgtaaatttcacagggcagggttaaaacagtgcctggcatatactgctaaatttcttcagtaaaagacagtttacccacaaataacttgacatgagtgtctcataggttttactaacacagtcaccattgcatcaattagttatcttctagagc

SEQ ID NO: 261502 - DNA, 334 bp, Homo sapiens
ctagagaatactgaagagctgaggccaaaaacattcaatgacaagggcagcgatgtttccttgtcaatatcaccactgacaaaaattaagttcagagcccaggaactagccacaggttcagggcctttcaaaacttcatacagctactttttcaaagatattttcaaatatgcccacttggggaaatcaaggtgggtcataggttttagaggctcattttctgcatcttcccaggaagagactgtaccactttgagctttcatgttctcatctataaaatgggaatagtaatagtacccacttcatagaggattcaataaaagtgttaaacaaa
